United States Patent 11,098,302 (IDENTIFICATION OF POLYNUCLEOTIDES ASSOCIATED WITH A SAMPLE) - sequence listing, part 144

SEQ ID NO: 539534 - DNA, 494 bp, Homo sapiens
  misc_feature: HIJSMM301B8XHG.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaaatgaactgtggctgcaccatctgtctt

SEQ ID NO: 539535 - DNA, 485 bp, Homo sapiens
  misc_feature: HIJSMM301BKNP7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaaacaatattattatacttcgtggacgttcggccaaggaccaaggtggatatcagacgaa

SEQ ID NO: 539536 - DNA, 485 bp, Homo sapiens
  misc_feature: HIJSMM301BAKE1.48.38.D05.1.454.light.4.raw
agtatacatacacgaccggtgctcgatttagtatctgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 539537 - DNA, 490 bp, Homo sapiens
  misc_feature: HIJSMM301A27PH.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtaggaggatacaaacgaa

SEQ ID NO: 539538 - DNA, 504 bp, Homo sapiens
  misc_feature: HIJSMM301CROG9.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgagatttgcagtttatactgtcaacagcgtagcagcaggcctccggcgacgttcggccaagggaccaaggtggaagtcaagcgaactgtggctgcaccatctgtcttcatcttcccgc

SEQ ID NO: 539539 - DNA, 499 bp, Homo sapiens; identical to SEQ ID NO: 537739
  misc_feature: HIJSMM301CTTKH.12.86.H09.1.454.light.4.raw

SEQ ID NO: 539540 - DNA, 513 bp, Homo sapiens
  misc_feature: HIJSMM301D3LIQ.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctgttccccg

SEQ ID NO: 539541 - DNA, 486 bp, Homo sapiens; identical to SEQ ID NO: 535385
  misc_feature: HIJSMM301C8HEA.19.71.G05.1.454.light.4.raw

SEQ ID NO: 539542 - DNA, 485 bp, Homo sapiens; identical to SEQ ID NO: 535688
  misc_feature: HIJSMM301DFRK0.19.5.A05.1.454.light.4.raw

SEQ ID NO: 539543 - DNA, 490 bp, Homo sapiens; identical to SEQ ID NO: 537951
  misc_feature: HIJSMM301C6MK6.19.57.F02.1.454.light.4.raw

SEQ ID NO: 539544 - DNA, 503 bp, Homo sapiens
  misc_feature: HIJSMM301BVEC7.4.6.A06.1.454.light.4.raw
agcactgtagcacgaccggtgctcgatttagatctactgacagggggcttcggctgtgggtagagaagacaggactcaggacaatctccagcatggccagcttccctctcctcctcaccctcctcactcactgtgcagggtcctgggtcccagtctgtcctgactcaggcaccctcagcgtctggggcccccggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccagggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgccccctc

SEQ ID NO: 539545 - DNA, 496 bp, Homo sapiens; identical to SEQ ID NO: 535109
  misc_feature: HIJSMM301ANUE7.16.78.H01.1.454.light.4.raw

SEQ ID NO: 539546 - DNA, 422 bp, Homo sapiens
  misc_feature: HIJSMM301B4JII.41.14.B03.1.454.light.4.raw
tctatactatcacgaccggtgctcgatttagtgtgagtagttccgcgggcacgaccggtgctcgatttagtagcatactgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539547 - DNA, 509 bp, Homo sapiens
  misc_feature: HIJSMM301AOGE4.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtctttcgtctccaggggaaagagccaccctctcctgcagggccagtcagaatgttggcgccttacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaagtggagatcaaacgaactgtggctgcaccatctgtcttcta

SEQ ID NO: 539548 - DNA, 486 bp, Homo sapiens
  misc_feature: HIJSMM301AZQ10.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgctaacttattattgtcaacaaagttatgagacccctgccacttcggccctggaccatagtggatatagaaacgaactgtggctgcacc

SEQ ID NO: 539549 - DNA, 491 bp, Homo sapiens; identical to SEQ ID NO: 537594
  misc_feature: HIJSMM301B3ZLU.4.24.C02.1.454.light.4.raw

SEQ ID NO: 539550 - DNA, 501 bp, Homo sapiens
  misc_feature: HIJSMM301CQMVL.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaacgaactgtggctgcaccatctgtcttcatcttcccg

SEQ ID NO: 539551 - DNA, 513 bp, Homo sapiens
  misc_feature: HIJSMM301BD85F.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcactctgttccccg

SEQ ID NO: 539552 - DNA, 449 bp, Homo sapiens
  misc_feature: HIJSMM301CI7F8.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgcccctcctccatactcgta

SEQ ID NO: 539553 - DNA, 460 bp, Homo sapiens
  misc_feature: HIJSMM301D9L68.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 539554 - DNA, 484 bp, Homo sapiens; identical to SEQ ID NO: 535240
  misc_feature: HIJSMM301A4B5F.47.60.F05.1.454.light.4.raw

SEQ ID NO: 539555 - DNA, 497 bp, Homo sapiens
  misc_feature: HIJSMM301D72XH.49.26.C04.1.454.light.4.raw
agtcgagagacacgaccggtgctcgatttagtctagcgactttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgtt

SEQ ID NO: 539556 - DNA, 484 bp, Homo sapiens
  misc_feature: HIJSMM301B5WAZ.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccccg

SEQ ID NO: 539557 - DNA, 498 bp, Homo sapiens
  misc_feature: HIJSMM301BMQ8U.51.23.C01.1.454.light.4.raw
cgatcgtatacacgaccggtgctcgatttagtacacgtgattagggattgggggctgtgggtccagggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaaccccactgt

SEQ ID NO: 539558 - DNA, 492 bp, Homo sapiens; identical to SEQ ID NO: 537509
  misc_feature: HIJSMM301D848I.13.46.E02.1.454.light.4.raw

SEQ ID NO: 539559 - DNA, 509 bp, Homo sapiens
  misc_feature: HIJSMM301C9H24.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaacggtaggaaagtacaaacgaactagtggctgcaccatctgtcttctatcttccccg

SEQ ID NO: 539560 - DNA, 485 bp, Homo sapiens; identical to SEQ ID NO: 536576
  misc_feature: HIJSMM301C1CT2.46.35.D02.1.454.light.4.raw

SEQ ID NO: 539561 - DNA, 459 bp, Homo sapiens
  misc_feature: HIJSMM301BYPV2.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctgtatctctcg

SEQ ID NO: 539562 - DNA, 518 bp, Homo sapiens
  misc_feature: HIJSMM301DDIZE.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctggtcactctgttcccacct

SEQ ID NO: 539563 - DNA, 500 bp, Homo sapiens
  misc_feature: HIJSMM301CY1ON.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgccat

SEQ ID NO: 539564 - DNA, 354 bp, Homo sapiens
  misc_feature: HIJSMM301AQ6I8.3.11.A11.1.454.light.4.raw
agacgcactccacgaccggtgctcgatttagctacgactgcaggggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtct

SEQ ID NO: 539565 - DNA, 486 bp, Homo sapiens; identical to SEQ ID NO: 537127
  misc_feature: HIJSMM301DUCUA.3.77.G11.1.454.light.4.raw

SEQ ID NO: 539566 - DNA, 503 bp, Homo sapiens
  misc_feature: HIJSMM301A5YA3.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctcgtattggtcatctttcaagataccgagcggccctcagagatccctgagcgattctctggctccaactctgggaacacagccactctgaccatcagcggggcccgagactatggatgaggctgactattactgtcaggcgtgggacagcaattctgtgattttcggtcggagggaccaagttgaccgtcctaggtcagcccaacggctcgccccctccggttcactcttc

SEQ ID NO: 539567 - DNA, 460 bp, Homo sapiens
  misc_feature: HIJSMM301BPH38.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgtcccctcggtcactctgttcccaccctcctcacgcgtatgt

SEQ ID NO: 539568 - DNA, 502 bp, Homo sapiens
  misc_feature: HIJSMM301C0HCA.48.83.H06.1.454.light.4.raw
agtatacatacacgaccggtgctcgatttagatcacgtgcgtcgcggggtgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccaccct

SEQ ID NO: 539569 - DNA, 484 bp, Homo sapiens; identical to SEQ ID NO: 535211
  misc_feature: HIJSMM301C9UW2.47.46.E02.1.454.light.4.raw

SEQ ID NO: 539570 - DNA, 494 bp, Homo sapiens; identical to SEQ ID NO: 535276
  misc_feature: HIJSMM301B4M0E.16.6.A06.1.454.light.4.raw

SEQ ID NO: 539571 - DNA, 492 bp, Homo sapiens
  misc_feature: HIJSMM301BN9NB.52.53.E09.1.454.light.4.raw
cgcagtacgacacgaccggtgctcgatttagagagagtgtgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccccg

SEQ ID NO: 539572 - DNA, 449 bp, Homo sapiens
  misc_feature: HIJSMM301BS36F.18.9.A09.1.454.light.4.raw
tacgagtatgcacgaccggtgctcgatttagcgagacgcgcagggtcctgggcccagtctgtgctgacgcagccgccctcagtatctggggccccagggcagagggtcaccatctcctgcactgggagcacctccaacatcggggcgggttatgatgtacactggtaccagcagcttccagggacagcccccaaactacccactctttggtagcaacaatcggccctcagggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctcctgtcactctgttcccgccctcctccatactcgta

SEQ ID NO: 539573 - DNA, 491 bp, Homo sapiens
  misc_feature: HIJSMM301C8L64.49.67.G01.1.454.light.4.raw
agtcgagagacacgaccggtgctcgatttagagtatacatattgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 539574 - DNA, 506 bp, Homo sapiens
  misc_feature: HIJSMM301A34FD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtccaaggaccgaacggtggaagtacaaacgaacacgtggctgcaccactctgtcttctatcttccccg

SEQ ID NO: 539575 - DNA, 491 bp, Homo sapiens; identical to SEQ ID NO: 536693
  misc_feature: HIJSMM301AK0Z1.19.83.H06.1.454.light.4.raw

SEQ ID NO: 539576 - DNA, 485 bp, Homo sapiens
  misc_feature: HIJSMM301C9H97.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcacc

SEQ ID NO: 539577 - DNA, 494 bp, Homo sapiens; identical to SEQ ID NO: 534992
  misc_feature: HIJSMM301AQAG0.9.1.A01.1.454.light.4.raw

SEQ ID NO: 539578 - DNA, 503 bp, Homo sapiens
  misc_feature: HIJSMM301BH4L2.48.8.A08.1.454.light.4.raw
agtatacatacacgaccggtgctcgatttagcatactctacagggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgccta

SEQ ID NO: 539579 - DNA, 490 bp, Homo sapiens
  misc_feature: HIJSMM301CKLU0.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccggtcttaggtcagcccaaggctgccccctccggtcact

SEQ ID NO: 539580 - DNA, 422 bp, Homo sapiens
  misc_feature: HIJSMM301C3MFC.41.12.B01.1.454.light.4.raw
tctatactatcacgaccggtgctcgatttagtagtgtagattccgcgggcacgaccggtgctcgatttagtagtgtagatttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539581 - DNA, 344 bp, Homo sapiens
  misc_feature: HIJSMM301C2J9C.21.87.H10.1.454.light.4.raw
tcgtcgctcgcacgaccggtgctcgatttagcagtactgcgttgggttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggtcactctgttcccaccctcctccgagcgacga

SEQ ID NO: 539582 - DNA, 490 bp, Homo sapiens
  misc_feature: HIJSMM301DH2LW.47.36.D03.1.454.light.4.raw
agctcacgtacacgaccggtgctcgatttagctgcgtcacgatctctcttgggggcaggagtcagacccagtcaggacacagcatggacatgagggtccccgcctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccat

SEQ ID NO: 539583 - DNA, 444 bp, Homo sapiens; identical to SEQ ID NO: 535192
  misc_feature: HIJSMM301EYCG0.5.9.A09.1.454.light.4.raw

SEQ ID NO: 539584 - DNA, 444 bp, Homo sapiens; identical to SEQ ID NO: 535594
  misc_feature: HIJSMM301D1DWN.9.9.A09.1.454.light.4.raw

SEQ ID NO: 539585 - DNA, 516 bp, Homo sapiens
  misc_feature: HIJSMM301AMOCA.43.23.C01.1.454.light.4.raw
tgtgagtagtcacgaccggtgctcgatttagtacacgtgattagggattgggggccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctcacta

SEQ ID NO: 539586 - DNA, 497 bp, Homo sapiens
  misc_feature: HIJSMM301ASGOJ.40.23.C01.1.454.light.4.raw
tctagcgactcacgaccggtgctcgatttagtacacgtgattagggattggggagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtgccgactggcccctcacgttcggcggagggaccaaggtggacatcaaacgaactgtggctgcaccat

SEQ ID NO: 539587 - DNA, 481 bp, Homo sapiens
  misc_feature: HIJSMM301D1CUR.47.60.F05.1.454.light.4.raw
agctcacgtacacgaccggtgctcgatttagtacgtcatcagggaaaggggaggaactgctcagttaggacccagacggaaccatggaagccccagcgcagcttctcttcctcctgctactctggctcccagataccactggcaaaatagtgctgacgcagtctccagccaccctgtctgcatctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcacc

SEQ ID NO: 539588 - DNA, 508 bp, Homo sapiens
  misc_feature: HIJSMM301B1NUH.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 539589 - DNA, 469 bp, Homo sapiens
  misc_feature: HIJSMM301BI4NC.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcgcggggggaccgaaggtggagatcaagcgaa

SEQ ID NO: 539590 - DNA, 491 bp, Homo sapiens
  misc_feature: HIJSMM301CIB75.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggcggagggaccgaacggacggagatcagacgaactgtggctgcaccatctgtcttcta

SEQ ID NO: 539591 - DNA, 482 bp, Homo sapiens
  misc_feature: HIJSMM301AL6H6.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaaccctcgaacgttcggccaggaccaacggtggaagtcaaacgaactagtggctgcaccat

SEQ ID NO: 539592 - DNA, 489 bp, Homo sapiens
  misc_feature: HIJSMM301COVTI.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcagtataatgtccgggctccggacactttcggcggagggaccaaggtggagatcaaacgaa

SEQ ID NO: 539593 - DNA, 474 bp, Homo sapiens
  misc_feature: HIJSMM301ASH1K.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccgaacggtggacatcaaacgaa

SEQ ID NO: 539594 - DNA, 483 bp, Homo sapiens
  misc_feature: HIJSMM301BQVMS.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaa

SEQ ID NO: 539595 - DNA, 378 bp, Homo sapiens
  misc_feature: HIJSMM301EJXYT.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggaacagacttcactctcacca

SEQ ID NO: 539596 - DNA, 311 bp, Homo sapiens
  misc_feature: HIJSMM301DQ3NW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccaggtcg

SEQ ID NO: 539597 - DNA, 496 bp, Homo sapiens; identical to SEQ ID NO: 535597
  misc_feature: HIJSMM301DUN2C.22.20.B09.1.454.light.4.raw

SEQ ID NO: 539598 - DNA, 486 bp, Homo sapiens; identical to SEQ ID NO: 535043
  misc_feature: HIJSMM301BMHPF.46.35.D02.1.454.light.4.raw

SEQ ID NO: 539599 - DNA, 422 bp, Homo sapiens
  misc_feature: HIJSMM301EKLHF.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcgggtcgaagccggggatgaggccgactatttctgtcagctgtgggattctcatgatggtagtgggggaatcttcggcggagggaccaggctgaccgtcctaagtcagcccaaggctgccccctcggtcactctgttcccaccctcctcagacgtatca

SEQ ID NO: 539600 - DNA, 493 bp, Homo sapiens
  misc_feature: HIJSMM301AW5G2.15.49.E05.1.454.light.4.raw
tctacgtagccacgaccggtgctcgatttagagcgactagcaacacacaaagggggaggaactgctcagttaggacccacgacggaaccatggaagccccacgcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggtccaacgggaccaacggtggaaatcaaacgaactgtggctgcaccat

SEQ ID NO: 539601 - DNA, 493 bp, Homo sapiens
  misc_feature: HIJSMM301B2FGL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaagacggagatcagacgaactagtggctgcaccactctcgtcttcta

SEQ ID NO: 539602 - DNA, 489 bp, Homo sapiens
  misc_feature: HIJSMM301AIVHZ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgactgtggctgcaccatctgtcttcat

SEQ ID NO: 539603 - DNA, 506 bp, Homo sapiens; identical to SEQ ID NO: 535404
  misc_feature: HIJSMM301AWH10.10.88.H11.1.454.light.4.raw

SEQ ID NO: 539604 - DNA, 495 bp, Homo sapiens; identical to SEQ ID NO: 537415
  misc_feature: HIJSMM301C6WBG.4.27.C05.1.454.light.4.raw

SEQ ID NO: 539605 - DNA, 484 bp, Homo sapiens
  misc_feature: HIJSMM301DOP6M.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgaa

SEQ ID NO: 539606 - DNA, 484 bp, Homo sapiens; identical to SEQ ID NO: 535400
  misc_feature: HIJSMM301AIKT1.46.26.C04.1.454.light.4.raw

SEQ ID NO: 539607 - DNA, 517 bp, Homo sapiens
  misc_feature: HIJSMM301DJD64.41.55.E11.1.454.light.4.raw
tctatactatcacgaccggtgctcgatttagcactcgcacgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccct

SEQ ID NO: 539608 - DNA, 497 bp, Homo sapiens; identical to SEQ ID NO: 537288
  misc_feature: HIJSMM301EFUB9.15.25.C03.1.454.light.4.raw

SEQ ID NO: 539609 - DNA, 502 bp, Homo sapiens
  misc_feature: HIJSMM301BNC8Y.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcctgggaccaagtggatatcaaacgaactgtggctgcaccatctgtt

SEQ ID NO: 539610 - DNA, 444 bp, Homo sapiens; identical to SEQ ID NO: 535192
  misc_feature: HIJSMM301BVWMG.5.9.A09.1.454.light.4.raw

SEQ ID NO: 539611 - DNA, 524 bp, Homo sapiens
  misc_feature: HIJSMM301DSA1O.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgcccccgtcgcactctcgttcccgccctcctcctagtctacg

SEQ ID NO: 539612 - DNA, 488 bp, Homo sapiens
  misc_feature: HIJSMM301BHLJ5.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgtt

SEQ ID NO: 539613 - DNA, 494 bp, Homo sapiens; identical to SEQ ID NO: 535629
  misc_feature: HIJSMM301EUUME.4.27.C05.1.454.light.4.raw

SEQ ID NO: 539614 - DNA, 445 bp, Homo sapiens
  misc_feature: HIJSMM301A6TBE.5.9.A09.1.454.light.4.raw
  modified_base (426)..(426): a, c, t, g, unknown or other
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccncccctcctccgtgtctgat

SEQ ID NO: 539615 - DNA, 501 bp, Homo sapiens; identical to SEQ ID NO: 535873
  misc_feature: HIJSMM301AYAPW.17.27.C05.1.454.light.4.raw

SEQ ID NO: 539616 - DNA, 489 bp, Homo sapiens
  misc_feature: HIJSMM301ARAGE.43.30.C08.1.454.light.4.raw
tgtgagtagtcacgaccggtgctcgatttagtctgacgtcaaagggaaagggggagtcagacccactcaggacacagcatggacatgagggtccccgctcagctcctggggctcctgctgctctggctcccaggtgccagatgtgccatccagatgacccagtctccgtcctccctgtatgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtggagtgtcaagacgaactcgtggctgcaccat

SEQ ID NO: 539617 - DNA, 507 bp, Homo sapiens; identical to SEQ ID NO: 535641
  misc_feature: HIJSMM301D9SUR.10.88.H11.1.454.light.4.raw

SEQ ID NO: 539618 - DNA, 422 bp, Homo sapiens
  misc_feature: HIJSMM301C43QT.41.14.B03.1.454.light.4.raw
tctatactatcacgaccggtgctcgatttagtgtgagtagttccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539619 - DNA, 501 bp, Homo sapiens; identical to SEQ ID NO: 536818
  misc_feature: HIJSMM301AQKMZ.12.82.H05.1.454.light.4.raw

SEQ ID NO: 539620 - DNA, 444 bp, Homo sapiens; identical to SEQ ID NO: 534993
  misc_feature: HIJSMM301BRNXN.5.9.A09.1.454.light.4.raw

SEQ ID NO: 539621 - DNA, 377 bp, Homo sapiens; identical to SEQ ID NO: 536071
  misc_feature: HIJSMM301ASITL.40.9.A09.1.454.light.4.raw

SEQ ID NO: 539622 - DNA, 494 bp, Homo sapiens; identical to SEQ ID NO: 534994
  misc_feature: HIJSMM301DM8EX.27.78.H01.1.454.light.4.raw

SEQ ID NO: 539623 - DNA, 511 bp, Homo sapiens
  misc_feature: HIJSMM301BPM8C.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagccccaaggctcgcccccc

SEQ ID NO: 539624 - DNA, 473 bp, Homo sapiens
  misc_feature: HIJSMM301EEKWC.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaa

SEQ ID NO: 539625 - DNA, 480 bp, Homo sapiens
  misc_feature: HIJSMM301EE2CE.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgctagtttattactgtcagcagtatactaactggcctctgacgttcggccaagggaccagggtaggaaatcaaacgaactgtgctgcaccat

SEQ ID NO: 539626 - DNA, 488 bp, Homo sapiens; identical to SEQ ID NO: 535081
  misc_feature: HIJSMM301BCPF4.26.23.C01.1.454.light.4.raw

SEQ ID NO: 539627 - DNA, 487 bp, Homo sapiens
  misc_feature: HIJSMM301AYVDU.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaacgaactgtggctgcaccat

SEQ ID NO: 539628 - DNA, 490 bp, Homo sapiens
  misc_feature: HIJSMM301D6A60.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcact

SEQ ID NO: 539629 - DNA, 496 bp, Homo sapiens; identical to SEQ ID NO: 535423
  misc_feature: HIJSMM301DR0ZC.3.33.C11.1.454.light.4.raw

SEQ ID NO: 539630 - DNA, 492 bp, Homo sapiens
  misc_feature: HIJSMM301EYEQV.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgt

SEQ ID NO: 539631 - DNA, 490 bp, Homo sapiens; identical to SEQ ID NO: 535526
  misc_feature: HIJSMM301BV6ED.26.78.H01.1.454.light.4.raw

SEQ ID NO: 539632 - DNA, 383 bp, Homo sapiens; identical to SEQ ID NO: 447524
  misc_feature: HIJSMM301B4BXL.41.26.C04.1.454.light.4.raw

SEQ ID NO: 539633 - DNA, 498 bp, Homo sapiens; identical to SEQ ID NO: 537020
  misc_feature: HIJSMM301D0F4M.26.26.C04.1.454.light.4.raw

SEQ ID NO: 539634 - DNA, 505 bp, Homo sapiens
  misc_feature: HIJSMM301AJS39.48.78.H01.1.454.light.4.raw
agtatacatacacgaccggtgctcgatttagtgtgagtagtttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 539635 - DNA, 497 bp, Homo sapiens; identical to SEQ ID NO: 536371
  misc_feature: HIJSMM301BJRGH.16.78.H01.1.454.light.4.raw

SEQ ID NO: 539636 - DNA, 486 bp, Homo sapiens; identical to SEQ ID NO: 535043
  misc_feature: HIJSMM301BG2P7.46.35.D02.1.454.light.4.raw

SEQ ID NO: 539637 - DNA, 496 bp, Homo sapiens; identical to SEQ ID NO: 535541
  misc_feature: HIJSMM301AHNA8.3.33.C11.1.454.light.4.raw

SEQ ID NO: 539638 - DNA, 445 bp, Homo sapiens
  misc_feature: HIJSMM301BMVDJ.18.9.A09.1.454.light.4.raw
  modified_base (427)..(427): a, c, t, g, unknown or other
tacgagtatgcacgaccggtgctcgatttagcgagacgcgcagggtcctgggcccagtctgtgctgacgcagcctccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaaccctctgtcactctgttcccnccctcctccatactcgta

SEQ ID NO: 539639 - DNA, 484 bp, Homo sapiens; identical to SEQ ID NO: 535240
  misc_feature: HIJSMM301D1PRT.47.60.F05.1.454.light.4.raw

SEQ ID NO: 539640 - DNA, 496 bp, Homo sapiens
  misc_feature: HIJSMM301B4H25.43.33.C11.1.454.light.4.raw
tgtgagtagtcacgaccggtgctcgatttagagtgagctcgttgggtttggggctcgatttagagtgagctcgttgggtttggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctccccctacctattacgttcggagacgggactaggtacaa

SEQ ID NO: 539641 - DNA, 498 bp, Homo sapiens
  misc_feature: HIJSMM301CXEDY.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctcctcagacgttcggccaagggaccaaggtggaaatcaaacgaactgtggctgcacca

SEQ ID NO: 539642 - DNA, 496 bp, Homo sapiens
  misc_feature: HIJSMM301CQCOG.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 539643 - DNA, 496 bp, Homo sapiens; identical to SEQ ID NO: 535109
  misc_feature: HIJSMM301ADB19.16.78.H01.1.454.light.4.raw

SEQ ID NO: 539644 - DNA, 445 bp, Homo sapiens
  misc_feature: HIJSMM301C5QGT.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgatttattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 539645 - DNA, 509 bp, Homo sapiens; identical to SEQ ID NO: 537131
  misc_feature: HIJSMM301AMPUW.17.33.C11.1.454.light.4.raw

SEQ ID NO: 539646 - DNA, 485 bp, Homo sapiens; identical to SEQ ID NO: 536630
  misc_feature: HIJSMM301C9SCI.13.56.F01.1.454.light.4.raw

SEQ ID NO: 539647 - DNA, 471 bp, Homo sapiens
  misc_feature: HIJSMM301ATND6.49.73.G07.1.454.light.4.raw
agtcgagagacacgaccggtgctcgatttagctctacgctcagggcacgaccggtgctcgatttagctctacgctctaagggaaagggggcaggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgct

SEQ ID NO: 539648 - DNA, 504 bp, Homo sapiens
  misc_feature: HIJSMM301CQYL3.10.29.C07.1.454.light.4.raw
catagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtca

SEQ ID NO: 539649 - DNA, 495 bp, Homo sapiens
  misc_feature: HIJSMM301C5L1C.21.65.F10.1.454.light.4.raw
tcgtcgctcgcacgaccggtgctcgatttagctacgctctaagggggagggaactgctcagttaggtacccacgacggaaccatggaagccccacgcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatccccagccaggttcagtggcactggggtctgggacagagttcactctcaccatcagcagcctgcagtctgaagattttgaagtttatttctgtctgcagtacaatcagtggcctcggacgttcggccaagggaccaaggtggaaatcaaacgaactgtggctgcaccatctgtcttcta

SEQ ID NO: 539650 - DNA, 475 bp, Homo sapiens; identical to SEQ ID NO: 539478
  misc_feature: HIJSMM301B0C2T.7.81.H04.1.454.light.4.raw

SEQ ID NO: 539651 - DNA, 496 bp, Homo sapiens
  misc_feature: HIJSMM301BLH3N.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctcttttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaaactgt

SEQ ID NO: 539652 - DNA, 501 bp, Homo sapiens
  misc_feature: HIJSMM301AV88Z.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcagacgtatca

SEQ ID NO: 539653 - DNA, 486 bp, Homo sapiens; identical to SEQ ID NO: 535385
  misc_feature: HIJSMM301E1EZ5.19.71.G05.1.454.light.4.raw

SEQ ID NO: 539654 - DNA, 444 bp, Homo sapiens; identical to SEQ ID NO: 535192
  misc_feature: HIJSMM301DH8KR.5.9.A09.1.454.light.4.raw

SEQ ID NO: 539655 - DNA, 507 bp, Homo sapiens
  misc_feature: HIJSMM301AJP6P.48.38.D05.1.454.light.4.raw
agtatacatacacgaccggtgctcgatttagtatctgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 539656 - DNA, 490 bp, Homo sapiens; identical to SEQ ID NO: 538273
  misc_feature: HIJSMM301ASXNS.16.73.G07.1.454.light.4.raw

SEQ ID NO: 539657 - DNA, 513 bp, Homo sapiens
  misc_feature: HIJSMM301CTDNN.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtctaggtcagcccaaggccaaccccactgtcactctgttcccgccctcctcgacc

SEQ ID NO: 539658 - DNA, 501 bp, Homo sapiens; identical to SEQ ID NO: 536818
  misc_feature: HIJSMM301CRRTQ.12.82.H05.1.454.light.4.raw

SEQ ID NO: 539659 - DNA, 444 bp, Homo sapiens; identical to SEQ ID NO: 535192
  misc_feature: HIJSMM301BWLBL.5.9.A09.1.454.light.4.raw

SEQ ID NO: 539660 - DNA, 473 bp, Homo sapiens
  misc_feature: HIJSMM301B9B2C.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaattagttcaccttaaggaacagccaagcgctagccagttaagtgaggcatctcaattgcaaggttttctctgcatcggtcaggttagtgatattaacagcgaaaagagatttttgttaagggaagtaatgaagttaacactgtggatcaccttcggccaagggacacgactggagattaaacgaactgtggctgcaccatctgtcttcatcttccgccatctgaagtatagtct

SEQ ID NO: 539661 - DNA, 487 bp, Homo sapiens; identical to SEQ ID NO: 536206
  misc_feature: HIJSMM301DO3GM.47.38.D05.1.454.light.4.raw

SEQ ID NO: 539662 - DNA, 484 bp, Homo sapiens; identical to SEQ ID NO: 538247
  misc_feature: HIJSMM301EVS21.14.53.E09.1.454.light.4.raw

SEQ ID NO: 539663 - DNA, 483 bp, Homo sapiens
  misc_feature: HIJSMM301APUX7.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatactgtatgcaaggtatagagcttcctccgacgttcggccaagggaccaaggtggaactcaaacgaactgtggctgcaccatctgtcttcatcttcccgccatctgactagtctacg

SEQ ID NO: 539664 - DNA, 486 bp, Homo sapiens; identical to SEQ ID NO: 535043
  misc_feature: HIJSMM301AEFGQ.46.35.D02.1.454.light.4.raw

SEQ ID NO: 539665 - DNA, 517 bp, Homo sapiens
  misc_feature: HIJSMM301A07FB.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtcactctgttcccgccctcctccacg

SEQ ID NO: 539666 - DNA, 486 bp, Homo sapiens; identical to SEQ ID NO: 535043
  misc_feature: HIJSMM301A3LD2.46.35.D02.1.454.light.4.raw

SEQ ID NO: 539667 - DNA, 506 bp, Homo sapiens; identical to SEQ ID NO: 535404
  misc_feature: HIJSMM301DP095.10.88.H11.1.454.light.4.raw

SEQ ID NO: 539668 - DNA, 497 bp, Homo sapiens; identical to SEQ ID NO: 535664
  misc_feature: HIJSMM301D3I2B.22.14.B03.1.454.light.4.raw

SEQ ID NO: 539669 - DNA, 502 bp, Homo sapiens; identical to SEQ ID NO: 536253
  misc_feature: HIJSMM301DJRFB.21.22.B11.1.454.light.4.raw

SEQ ID NO: 539670 - DNA, 484 bp, Homo sapiens; identical to SEQ ID NO: 535211
  misc_feature: HIJSMM301A9OKU.47.46.E02.1.454.light.4.raw

SEQ ID NO: 539671 - DNA, 486 bp, Homo sapiens; identical to SEQ ID NO: 536329
  misc_feature: HIJSMM301ALEAP.21.4.A04.1.454.light.4.raw

SEQ ID NO: 539672 - DNA, 497 bp, Homo sapiens; identical to SEQ ID NO: 534982
  misc_feature: HIJSMM301D1MLA.26.80.H03.1.454.light.4.raw

SEQ ID NO: 539673 - DNA, 497 bp, Homo sapiens; identical to SEQ ID NO: 538296
  misc_feature: HIJSMM301AXRNR.18.11.A11.1.454.light.4.raw

SEQ ID NO: 539674 - DNA, 501 bp, Homo sapiens; identical to SEQ ID NO: 535746
  misc_feature: HIJSMM301AF0Z9.18.11.A11.1.454.light.4.raw

SEQ ID NO: 539675 - DNA, 491 bp, Homo sapiens
  misc_feature: HIJSMM301DRDTK.22.65.F10.1.454.light.4.raw
  modified_base (453)..(453): a, c, t, g, unknown or other
  modified_base (467)..(467): a, c, t, g, unknown or other
  modified_base (482)..(482): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgaccactacctccgtcgacggacgacacgngagataactaaacntggcgtgcaccactntcgtcttct

SEQ ID NO: 539676 - DNA, 486 bp, Homo sapiens; identical to SEQ ID NO: 535523
  misc_feature: HIJSMM301EOPGB.22.73.G07.1.454.light.4.raw

SEQ ID NO: 539677 - DNA, 470 bp, Homo sapiens
  misc_feature: HIJSMM301CUAR0.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcgccaaggaccaaggtggaaatacaaacgaactagt

SEQ ID NO: 539678 - DNA, 513 bp, Homo sapiens
  misc_feature: HIJSMM301BWYGG.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccg

SEQ ID NO: 539679 - DNA, 502 bp, Homo sapiens
  misc_feature: HIJSMM301DMROM.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaaatcaaacgaactgtggctgcaccatctgtcttcta

SEQ ID NO: 539680 - DNA, 444 bp, Homo sapiens
  misc_feature: HIJSMM301CO8PG.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttgggtgttcggcggagggaccaagctgaccgtcctaagtcagcccaaggctgcccctcggtcactctgttcccgccctcctccgtgtctgat

SEQ ID NO: 539681 - DNA, 512 bp, Homo sapiens
  misc_feature: HIJSMM301ED923.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccagggaccgacacgtagaaatagagacgaactacgtggctggcaccactactcgtcttctactcttcccgt

SEQ ID NO: 539682 - DNA, 483 bp, Homo sapiens
  misc_feature: HIJSMM301BUHEA.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccat

SEQ ID NO: 539683 - DNA, 497 bp, Homo sapiens; identical to SEQ ID NO: 538296
  misc_feature: HIJSMM301AQD1G.18.11.A11.1.454.light.4.raw

SEQ ID NO: 539684 - DNA, 490 bp, Homo sapiens
  misc_feature: HIJSMM301AEFG5.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggcgtgaggatgttggcatttattactgcatgcaggctatacaccttcctgccacttttggtccgaggggaccaagctggagatcaggcgaacg

SEQ ID NO: 539685 - DNA, 454 bp, Homo sapiens; identical to SEQ ID NO: 534964
  misc_feature: HIJSMM301ADNQJ.19.86.H09.1.454.light.4.raw

SEQ ID NO: 539686 - DNA, 463 bp, Homo sapiens; identical to SEQ ID NO: 535062
  misc_feature: HIJSMM301AT39B.11.73.G07.1.454.light.4.raw

SEQ ID NO: 539687 - DNA, 492 bp, Homo sapiens; identical to SEQ ID NO: 535126
  misc_feature: HIJSMM301A59Y5.18.11.A11.1.454.light.4.raw

SEQ ID NO: 539688 - DNA, 494 bp, Homo sapiens; identical to SEQ ID NO: 534992
  misc_feature: HIJSMM301EZOCU.9.1.A01.1.454.light.4.raw

SEQ ID NO: 539689 - DNA, 498 bp, Homo sapiens; identical to SEQ ID NO: 536208
  misc_feature: HIJSMM301AZ1TQ.11.75.G09.1.454.light.4.raw

SEQ ID NO: 539690 - DNA, 504 bp, Homo sapiens
  misc_feature: HIJSMM301D9X2T.47.65.F10.1.454.light.4.raw
agctcacgtacacgaccggtgctcgatttagctacgctctaaggggagctgtgggtagagaagacaggactcaggacaatctccagcatggccagcttccctctcctcctcaccctcctcactcactgtgcagggtcctgggcccagtctgcgttgactcagccaccctcagtgtctgggacccccgggcagacggtcgccgtctcttgttctggaagcggctccaacatcggccgtaattctgtaaactggtaccagcagctcccaggaatggcccccacactcctcatctatagggatgatcagtggccctcaggggtccctgaccgattctctggctccaagtctggcacttcagcctccctggccatcagtgggctccagtctggggatgaggctgattattactgtgcaacatgggatgacagtctgaacgcaatggtgttcggcggagggaccaaggtggccgtcctaggtcagcccaaggctgccccctcggtcact

SEQ ID NO: 539691 - DNA, 485 bp, Homo sapiens
  misc_feature: HIJSMM301EW7TB.15.1.A01.1.454.light.4.raw
  modified_base (467)..(467): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccnccctcctcgctacgtaga

SEQ ID NO: 539692 - DNA, 497 bp, Homo sapiens
  misc_feature: HIJSMM301BKTMN.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccagatgccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 539693 - DNA, 447 bp, Homo sapiens; identical to SEQ ID NO: 535201
  misc_feature: HIJSMM301DY1BI.18.9.A09.1.454.light.4.raw

SEQ ID NO: 539694 - DNA, 514 bp, Homo sapiens
  misc_feature: HIJSMM301C7TIM.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtagac

SEQ ID NO: 539695 - DNA, 481 bp, Homo sapiens; identical to SEQ ID NO: 539249
  misc_feature: HIJSMM301CADW2.11.76.G10.1.454.light.4.raw

SEQ ID NO: 539696 - DNA, 447 bp, Homo sapiens; identical to SEQ ID NO: 535201
  misc_feature: HIJSMM301C623T.18.9.A09.1.454.light.4.raw

SEQ ID NO: 539697 - DNA, 508 bp, Homo sapiens
  misc_feature: HIJSMM301AXZNU.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccgagggtggaaagtacaaacgaaactagtggctgcaccatctgtcttctatcttccccg

SEQ ID NO: 539698 - DNA, 490 bp, Homo sapiens; identical to SEQ ID NO: 535526
  misc_feature: HIJSMM301ALAX9.26.78.H01.1.454.light.4.raw

SEQ ID NO: 539699 - DNA, 454 bp, Homo sapiens; identical to SEQ ID NO: 535005
  misc_feature: HIJSMM301BB8YC.19.86.H09.1.454.light.4.raw

SEQ ID NO: 539700 - DNA, 441 bp, Homo sapiens
  misc_feature: HIJSMM301CJR19.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggccccaaactcctcatctataccaatgatgtgcggccctcagggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtactagacg

SEQ ID NO: 539701 - DNA, 497 bp, Homo sapiens
  misc_feature: HIJSMM301A8WCT.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagccgtgcagtctgaagattttgaagtttatttctgtctgcagtacaatcagtggcctcggacgttcggccgaacgggaccgaaggtaggaaatacaaacgaactagtggctgcaccatctgtcttcta

SEQ ID NO: 539702 - DNA, 493 bp, Homo sapiens
  misc_feature: HIJSMM301CRIRQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggcacgactggagattaaacgaactgtggctgcaccatctgtctt

SEQ ID NO: 539703 - DNA, 486 bp, Homo sapiens
  misc_feature: HIJSMM301AYYU4.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacgatccgagactgacccagtctccctccaccgtgtctgcatccgtaggagacagagtcaccatcacctgccgggccagtcagaatattaatagttggttggcctggtatcaccagaggccaggagaggcccccaaagctccttatttatgatgcctccactttgattagtggggtcccaccaacgttcagcgacagtggatctgggacagagttcactctcaccatcagcagcctgcagcctgatgatcttggaacttattactgccaacaatataatagttattggacgttcggccaggggaccaaggtcgaaatgagacgaactgtggctgcaccat

SEQ ID NO: 539704 - DNA, 483 bp, Homo sapiens
  misc_feature: HIJSMM301AFXUQ.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggcgtgtagatgaggctgactattactgtcaggcggtgggacagcagcactgaggtgttcggcggagggaccgaagctgaccgtcctacgtcagcccaacggc

SEQ ID NO: 539705 - DNA, 506 bp, Homo sapiens
  misc_feature: HIJSMM301ANT23.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggccccctcacgttcggcggagggaccaaggtggacatcaaacgaactgtggctgcaccatctgtcttcatcttcccgcc

SEQ ID NO: 539706 - DNA, 492 bp, Homo sapiens; identical to SEQ ID NO: 536010
  misc_feature: HIJSMM301BKJ5Y.10.20.B09.1.454.light.4.raw

SEQ ID NO: 539707 - DNA, 502 bp, Homo sapiens
  misc_feature: HIJSMM301EVESU.7.76.G10.1.454.light.4.raw
cgtgtctctacacgaccggtgctcgatttagtcactcatacagggggcgaggagtcagacccacgtcaggacacagcatggacatgagggtccccgcctcagctcctggggcgtcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcacccttggcgggggaccggaacgtaggaggagtactaaacgaaaccgtgttggcgtctcgacccaactc

SEQ ID NO: 539708 - DNA, 479 bp, Homo sapiens
  misc_feature: HIJSMM301AZUHP.43.87.H10.1.454.light.4.raw
tgtgagtagtcacgaccggtgctcgatttagcagtactgcgttgggtttggggctccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatggacagcagcctcagtgcttgggtgttcggcggagggaccaagctgaccgtccg

SEQ ID NO: 539709 - DNA, 484 bp, Homo sapiens; identical to SEQ ID NO: 536162
  misc_feature: HIJSMM301CUCF5.13.59.F04.1.454.light.4.raw

SEQ ID NO: 539710 - DNA, 487 bp, Homo sapiens; identical to SEQ ID NO: 537220
  misc_feature: HIJSMM301CQ18Q.16.53.E09.1.454.light.4.raw

SEQ ID NO: 539711 - DNA, 494 bp, Homo sapiens
  misc_feature: HIJSMM301AMTGK.4.22.B11.1.454.light.4.raw
agcactgtagcacgaccggtgctcgatttagacgacagctcaggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccatctgtctt

SEQ ID NO: 539712 - DNA, 481 bp, Homo sapiens
  misc_feature: HIJSMM301DPX75.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctccg

SEQ ID NO: 539713 - DNA, 474 bp, Homo sapiens
  misc_feature: HIJSMM301BRTUO.5.28.C06.1.454.light.4.raw
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcacc

SEQ ID NO: 539714 - DNA, 498 bp, Homo sapiens
  misc_feature: HIJSMM301DQTOK.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagcgtgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 539715 - DNA, 477 bp, Homo sapiens
  misc_feature: HIJSMM301E0AGE.48.51.E07.1.454.light.4.raw
agtatacatacacgaccggtgctcgatttagcatactctacaacacacaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaaacgaact

SEQ ID NO: 539716 - DNA, 493 bp, Homo sapiens
  misc_feature: HIJSMM301AFNYX.52.54.E10.1.454.light.4.raw
cgcagtacgacacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 539717 - DNA, 487 bp, Homo sapiens
  misc_feature: HIJSMM301AIO18.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccaggggaccaagctggagatcacaggaactgtggctgcacc

SEQ ID NO: 539718 - DNA, 497 bp, Homo sapiens
  misc_feature: HIJSMM301EXHUI.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccctcggt

SEQ ID NO: 539719 - DNA, 516 bp, Homo sapiens
  misc_feature: HIJSMM301AJI08.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcgggcggagggaccgaagctgaccgtcctaagtcagcccaaggctgccccctcggtcactctgttccgccctcctcg

SEQ ID NO: 539720 - DNA, 463 bp, Homo sapiens; identical to SEQ ID NO: 536878
  misc_feature: HIJSMM301DGZMR.26.78.H01.1.454.light.4.raw

SEQ ID NO: 539721 - DNA, 506 bp, Homo sapiens
  misc_feature: HIJSMM301CXPVC.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 539722 - DNA, 495 bp, Homo sapiens
  misc_feature: HIJSMM301AM869.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaa

SEQ ID NO: 539723 - DNA, 443 bp, Homo sapiens
  misc_feature: HIJSMM301EALPF.11.3.A03.1.454.light.4.raw
  modified_base (425)..(425): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccaacaaacagcccccaaactcctcatatatggtaacagcattcggccctcaggggtcccgtgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccnccctcctcgtatctctcg

SEQ ID NO: 539724 - DNA, 507 bp, Homo sapiens
  misc_feature: HIJSMM301D7CMD.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggcccaggccaatctccaaggcgcctaatttataaggtttccaaccgggactctggggtcccagacagattcagcggcagtgggtcaggcactgatttcacactggaaatcagcagggtggaggctgaggatgttggggtttattactgtcatgcaaactacacacgccgctcactttcggcggagggaccaaggtggagatcaaacgaactgtggctgcaccatctgtt

SEQ ID NO: 539725 - DNA, 494 bp, Homo sapiens; identical to SEQ ID NO: 534992
  misc_feature: HIJSMM301D0MFP.9.1.A01.1.454.light.4.raw

SEQ ID NO: 539726 - DNA, 508 bp, Homo sapiens; identical to SEQ ID NO: 536388
  misc_feature: HIJSMM301DCXL9.11.57.F02.1.454.light.4.raw

SEQ ID NO: 539727 - DNA, 441 bp, Homo sapiens
  misc_feature: HIJSMM301ENQUL.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggtcctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 539728 - DNA, 493 bp, Homo sapiens
  misc_feature: HIJSMM301CXTE8.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacttcggccaagggaccaaggtggatatcagacgaactgtggctgca

SEQ ID NO: 539729 - DNA, 483 bp, Homo sapiens; identical to SEQ ID NO: 535480
  misc_feature: HIJSMM301AN626.46.26.C04.1.454.light.4.raw

SEQ ID NO: 539730 - DNA, 478 bp, Homo sapiens
  misc_feature: HIJSMM301A4VXD.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcaaagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcacc

SEQ ID NO: 539731 - DNA, 519 bp, Homo sapiens
  misc_feature: HIJSMM301DZQ7H.27.23.C01.1.454.light.4.raw
  modified_base (516)..(516): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggaccaggctgaccgtcctaggtcagcccaaggctgccccctcggtcactctgttcccncct

SEQ ID NO: 539732 - DNA, 492 bp, Homo sapiens
  misc_feature: HIJSMM301DWQU3.4.9.A09.1.454.light.4.raw
agcactgtagcacgaccggtgctcgatttagcgagacgcgcagggggaggaactgctcagttaggacccagacggaaccatggaagccccagcgcagcttcttttcctcctgctactctggctcccagataccactggagaaatagtgatgacgcagtctccagccaccctgtctgtgtctccaggggcaagggccaccctctcctgcagggccagtcagagtgtcagcaacaacttagcctggtaccagcagaaacctggccagcctcccaggctcctcatctatggtacatccaccagggccactggtattccagtcaggtttagtggcagcgggtctgggacagaattcactctcaccatcagcagcctgcagtctgaagattttgcagtttattactgtcagcagtataataattggcctcccttcactttcggccctgggaccaaagtggatatcaaacgaactgtggctgcaccatctgtcttcta

SEQ ID NO: 539733 - DNA, 488 bp, Homo sapiens
  misc_feature: HIJSMM301A6UJR.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccaaagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaagctcg

SEQ ID NO: 539734 - DNA, 476 bp, Homo sapiens
  misc_feature: HIJSMM301EC3WG.51.47.E03.1.454.light.4.raw
cgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagccccg

SEQ ID NO: 539735 - DNA, 500 bp, Homo sapiens
  misc_feature: HIJSMM301DIVSQ.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagccaaggctgcccctcggtcactctgttccccg

SEQ ID NO: 539736 - DNA, 383 bp, Homo sapiens; identical to SEQ ID NO: 538995
  misc_feature: HIJSMM301EQSEB.41.55.E11.1.454.light.4.raw

SEQ ID NO: 539737 - DNA, 501 bp, Homo sapiens; identical to SEQ ID NO: 536818
  misc_feature: HIJSMM301BUIPP.12.82.H05.1.454.light.4.raw

SEQ ID NO: 539738 - DNA, 460 bp, Homo sapiens; identical to SEQ ID NO: 536053
  misc_feature: HIJSMM301BK0C8.22.28.C06.1.454.light.4.raw

SEQ ID NO: 539739 - DNA, 489 bp, Homo sapiens; identical to SEQ ID NO: 535139
  misc_feature: HIJSMM301EQP2Y.14.55.E11.1.454.light.4.raw

SEQ ID NO: 539740 - DNA, 492 bp, Homo sapiens
  misc_feature: HIJSMM301DRX0P.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttc

SEQ ID NO: 539741 - DNA, 490 bp, Homo sapiens
  misc_feature: HIJSMM301EK8XN.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggagggaccaacgtggaggtcaaacgaactgtggctgcaccatct

SEQ ID NO: 539742 - DNA, 485 bp, Homo sapiens
  misc_feature: HIJSMM301AJ8HC.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaagaa

SEQ ID NO: 539743 - DNA, 491 bp, Homo sapiens
  misc_feature: HIJSMM301AVB6F.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgacgacggagatcagacgaacgtagtggcgtgcaccactctcgtcttcta

SEQ ID NO: 539744 - DNA, 485 bp, Homo sapiens; identical to SEQ ID NO: 536040
  misc_feature: HIJSMM301AL2X2.15.1.A01.1.454.light.4.raw

SEQ ID NO: 539745 - DNA, 457 bp, Homo sapiens
  misc_feature: HIJSMM301C7EPW.49.83.H06.1.454.light.4.raw
agtcgagagacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 539746 - DNA, 487 bp, Homo sapiens; identical to SEQ ID NO: 536206
  misc_feature: HIJSMM301D9H5T.47.38.D05.1.454.light.4.raw

SEQ ID NO: 539747 - DNA, 484 bp, Homo sapiens; identical to SEQ ID NO: 535400
  misc_feature: HIJSMM301BDJWM.46.26.C04.1.454.light.4.raw

SEQ ID NO: 539748 - DNA, 486 bp, Homo sapiens; identical to SEQ ID NO: 535385
  misc_feature: HIJSMM301AMR0N.19.71.G05.1.454.light.4.raw

SEQ ID NO: 539749 - DNA, 472 bp, Homo sapiens
  misc_feature: HIJSMM301B5PRV.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtccaagtcagccc

SEQ ID NO: 539750 - DNA, 509 bp, Homo sapiens
  misc_feature: HIJSMM301EEV64.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactgggagcctgaagattttgcagtatattactgtcagcaatatggtacttcaccccggacgtttggtccgaagggaccaaggtggaaggtacaaacgaactgtggctgcaccatctgtcttcatcttcccgccat

SEQ ID NO: 539751 - DNA, 481 bp, Homo sapiens
  misc_feature: HIJSMM301CMMGX.51.35.D02.1.454.light.4.raw
cgatcgtatacacgaccggtgctcgatttagcacacgatagttgggtttggggctttccctggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtaccccctcagctcactttcggcggagggaccaaggtggagatcaaacgaactgtggctgcaccatctgtcttcatcttcccgccat

SEQ ID NO: 539752 - DNA, 507 bp, Homo sapiens
  misc_feature: HIJSMM301AIUX4.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcact

SEQ ID NO: 539753 - DNA, 497 bp, Homo sapiens; identical to SEQ ID NO: 535664
  misc_feature: HIJSMM301CNJC9.22.14.B03.1.454.light.4.raw

SEQ ID NO: 539754 - DNA, 499 bp, Homo sapiens
  misc_feature: HIJSMM301CV063.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 539755 - DNA, 476 bp, Homo sapiens; identical to SEQ ID NO: 537368
  misc_feature: HIJSMM301BX859.7.83.H06.1.454.light.4.raw

SEQ ID NO: 539756 - DNA, 481 bp, Homo sapiens
  misc_feature: HIJSMM301BPDV3.40.83.H06.1.454.light.4.raw
tctagcgactcacgaccggtgctcgatttagatcacgtgcgtcgcggggcaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagg

SEQ ID NO: 539757 - DNA, 472 bp, Homo sapiens
  misc_feature: HIJSMM301CRE3B.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagattttcactctcgccatcagtagtctgcaacctgatgattttgcaacttactactgtcaacagagttccactaccccaatcactttcggccctgggactgaagtgcatatgaagagaactgtgg

SEQ ID NO: 539758 - DNA, 498 bp, Homo sapiens
  misc_feature: HIJSMM301BT955.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccttgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccattgacat

SEQ ID NO: 539759 - DNA, 499 bp, Homo sapiens; identical to SEQ ID NO: 536030
  misc_feature: HIJSMM301A9PTN.48.23.C01.1.454.light.4.raw

SEQ ID NO: 539760 - DNA, 492 bp, Homo sapiens
  misc_feature: HIJSMM301DW454.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 539761 - DNA, 499 bp, Homo sapiens
  misc_feature: HIJSMM301A6E79.41.71.G05.1.454.light.4.raw
tctatactatcacgaccggtgctcgatttagtgtcgtcgcaagagagaggggggagtcagacccagtcaggacacagcatggacatgagggtccccgctcagctcctgggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagccccctaaactcctgatctataaggcgtctactttagagagtgggtcccttcaaggttcagtggcagtggatctgggacagagttcaccctcaccatcggcagcctgcagcctgaagatatcgcaacttattactgtcaacaatataacacttattcaggggcattcggccaagggccaaggtggaaattaaacgaactgtggctgcaccatctgtcttcatcttcccg

SEQ ID NO: 539762 - DNA, 484 bp, Homo sapiens; identical to SEQ ID NO: 539370
  misc_feature: HIJSMM301CHP1E.22.73.G07.1.454.light.4.raw

SEQ ID NO: 539763 - DNA, 494 bp, Homo sapiens
  misc_feature: HIJSMM301CUUWX.49.35.D02.1.454.light.4.raw
agtcgagagacacgaccggtgctcgatttagcacacgatagttgggtttgggggctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctgcaagcaggtccaatattgcgaatgagtatgtttcctggtaccagcacctcccaggaacagtccccaaactcctcatttatgacaataataggcgaccctcagggattcctgaccgattctctggctccaagtctgccgcgtcagccaccctgggcatcaccggactccagactggggacgaggtcgattattactgcgcaataggggatagaagtctgagtgctggcagggtgttcggcggagggaccaaggctgaccgtcct

SEQ ID NO: 539764 - DNA, 503 bp, Homo sapiens
  misc_feature: HIJSMM301AW8DP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgtcctaggtcagcccaa

SEQ ID NO: 539765 - DNA, 498 bp, Homo sapiens
  misc_feature: HIJSMM301D2W4F.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaacccccactgt

SEQ ID NO: 539766 - DNA, 474 bp, Homo sapiens
  misc_feature: HIJSMM301AFOGJ.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaactttactactgtcaacagtagtttcagtatcccttggactttcggccaagggaccaaggtggaaatcaaacgaa

SEQ ID NO: 539767 - DNA, 444 bp, Homo sapiens; identical to SEQ ID NO: 534993
  misc_feature: HIJSMM301DXDJX.5.9.A09.1.454.light.4.raw

SEQ ID NO: 539768 - DNA, 500 bp, Homo sapiens
  misc_feature: HIJSMM301C9BTT.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctggggatgaggctgattattattgctgctcatatggaagtacctactcttttctcttcggaactgggaccacggtcaccgtcctaggtcagcccaaggccaaccccactgt

SEQ ID NO: 539769 - DNA, 492 bp, Homo sapiens; identical to SEQ ID NO: 534967
  misc_feature: HIJSMM301CAVDG.47.64.F09.1.454.light.4.raw

SEQ ID NO: 539770 - DNA, 484 bp, Homo sapiens; identical to SEQ ID NO: 537689
  misc_feature: HIJSMM301DGEH0.19.71.G05.1.454.light.4.raw

SEQ ID NO: 539771 - DNA, 495 bp, Homo sapiens
  misc_feature: HIJSMM301C2WZQ.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccttaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgcatctgac

SEQ ID NO: 539772 - DNA, 488 bp, Homo sapiens
  misc_feature: HIJSMM301BSWO1.40.59.F04.1.454.light.4.raw
  modified_base (448)..(448): a, c, t, g, unknown or other
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggngggacggaacgactcgacgtccgtacgtacgtacgacccg

SEQ ID NO: 539773 - DNA, 507 bp, Homo sapiens
  misc_feature: HIJSMM301BI623.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttctatcttcccgcc

SEQ ID NO: 539774 - DNA, 465 bp, Homo sapiens
  misc_feature: HIJSMM301ASXL6.43.75.G09.1.454.light.4.raw
tgtgagtagtcacgaccggtgctcgatttagtatagacatcagggggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccagggaccaagctggagatcaatcgaactgt

SEQ ID NO: 539775 - DNA, 482 bp, Homo sapiens; identical to SEQ ID NO: 535216
  misc_feature: HIJSMM301AYLAI.17.26.C04.1.454.light.4.raw

SEQ ID NO: 539776 - DNA, 517 bp, Homo sapiens
  misc_feature: HIJSMM301B13WC.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctcgttcccacctcctccacg

SEQ ID NO: 539777 - DNA, 496 bp, Homo sapiens
  misc_feature: HIJSMM301AL678.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccgaggggagagagccaccctctcctgcaggaccagtcagagtgttaccagcaactacttggcctggtaccagcaagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 539778 - DNA, 510 bp, Homo sapiens
  misc_feature: HIJSMM301DDVXZ.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattactttgttgctcttgggcaactactgtcgtttgggtgttcggcggagggccaagttgaccgtcctaggtcagcccaaggctgccccctcggtcactctgttcccg

SEQ ID NO: 539779 - DNA, 514 bp, Homo sapiens
  misc_feature: HIJSMM301AVWQG.3.59.F04.1.454.light.4.raw
agacgcactccacgaccggtgctcgatttagtacacacacttagggattggggagcttcagctgtgggtagagaagacaggactcaggacaatctccagcatggccagcttccctctcctcctcaccctcctcgctcactgtgcagggtcctgggcccagtctgtgctgactcaggcaccctcagcgtctggggcccccggacagagagtcaccattttttgttctggaagcagctccaacatcggaaggaataatgtaaactggtaccaacaccttccaggatcggcccccaaacacctcatctatagtaataatgagcgcccctcaggggtcccggtccgattctctggctccaggtctggcacctcagcctccctggccatcagtgggctccagtctgacgatgaggctgattattactgttcatcttgggattccaacctcataatcggatattcggcggagggaccaagctgaccgtcctgggtcagcccaaggctgccccctcggtca

SEQ ID NO: 539780 - DNA, 497 bp, Homo sapiens; identical to SEQ ID NO: 535286
  misc_feature: HIJSMM301CNOC7.18.59.F04.1.454.light.4.raw

SEQ ID NO: 539781 - DNA, 510 bp, Homo sapiens; identical to SEQ ID NO: 538614
  misc_feature: HIJSMM301D0NGQ.19.59.F04.1.454.light.4.raw

SEQ ID NO: 539782 - DNA, 471 bp, Homo sapiens; identical to SEQ ID NO: 537461
  misc_feature: HIJSMM301AMZ1R.7.81.H04.1.454.light.4.raw

SEQ ID NO: 539783 - DNA, 518 bp, Homo sapiens
  misc_feature: HIJSMM301BR2K3.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacagaccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccaccctcctccacg

SEQ ID NO: 539784 - DNA, 494 bp, Homo sapiens
  misc_feature: HIJSMM301BTP2Q.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcat

SEQ ID NO: 539785 - DNA, 503 bp, Homo sapiens
  misc_feature: HIJSMM301CQBTO.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 539786 - DNA, 444 bp, Homo sapiens; identical to SEQ ID NO: 534993
  misc_feature: HIJSMM301BXAY8.5.9.A09.1.454.light.4.raw

SEQ ID NO: 539787 - DNA, 485 bp, Homo sapiens; identical to SEQ ID NO: 535985
  misc_feature: HIJSMM301DID6R.15.1.A01.1.454.light.4.raw

SEQ ID NO: 539788 - DNA, 509 bp, Homo sapiens; identical to SEQ ID NO: 536047
  misc_feature: HIJSMM301AM2L5.17.33.C11.1.454.light.4.raw

SEQ ID NO: 539789 - DNA, 486 bp, Homo sapiens
  misc_feature: HIJSMM301BS565.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctcggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 539790 - DNA, 484 bp, Homo sapiens; identical to SEQ ID NO: 536162
  misc_feature: HIJSMM301AL0C6.13.59.F04.1.454.light.4.raw

SEQ ID NO: 539791 - DNA, 475 bp, Homo sapiens
  misc_feature: HIJSMM301CPXGA.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacca

SEQ ID NO: 539792 - DNA, 460 bp, Homo sapiens
  misc_feature: HIJSMM301BU34L.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 539793 - DNA, 479 bp, Homo sapiens
  misc_feature: HIJSMM301AXKTS.13.34.D01.1.454.light.4.raw
tcacgtactacacgaccggtgctcgatttagatcgtctgtgttgggtttggggagagctctggggaggaactgctcagttaggacccagacggaaccatggaagccccagcgcagcttctcttcctcctgctactctggctcccagatactactggagaagtagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcaatgggtctgggacagacttcactctcaccatcagcagcctgcagtctgaagattttgcagtctattactgtcagcagtatagttactggagaaccttcggccaagggacacgactggagattaaaggaa

SEQ ID NO: 539794 - DNA, 492 bp, Homo sapiens; identical to SEQ ID NO: 536087
  misc_feature: HIJSMM301DWOLD.10.17.B06.1.454.light.4.raw

SEQ ID NO: 539795 - DNA, 500 bp, Homo sapiens
  misc_feature: HIJSMM301C8V5Y.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgaactgtggctgcaccatctgtcttcatt

SEQ ID NO: 539796 - DNA, 486 bp, Homo sapiens
  misc_feature: HIJSMM301CFS31.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcgccaggaccagtggaggtcagacgaactagtggctgcaccatctgtcttt

SEQ ID NO: 539797 - DNA, 511 bp, Homo sapiens
  misc_feature: HIJSMM301CI444.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggtcggagggaccaagttgaccgtcctaggtcagcccaaggctgccccctccggtcactctgtt

SEQ ID NO: 539798 - DNA, 517 bp, Homo sapiens
  misc_feature: HIJSMM301BGL9D.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactgtcactctcg

SEQ ID NO: 539799 - DNA, 444 bp, Homo sapiens
  misc_feature: HIJSMM301B5E7O.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctccttcgtgtctgat

SEQ ID NO: 539800 - DNA, 482 bp, Homo sapiens
  misc_feature: HIJSMM301BMONF.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggacc

SEQ ID NO: 539801 - DNA, 486 bp, Homo sapiens; identical to SEQ ID NO: 535385
  misc_feature: HIJSMM301CJDPJ.19.71.G05.1.454.light.4.raw

SEQ ID NO: 539802 - DNA, 504 bp, Homo sapiens; identical to SEQ ID NO: 535128
  misc_feature: HIJSMM301EUKMX.19.85.H08.1.454.light.4.raw

SEQ ID NO: 539803 - DNA, 501 bp, Homo sapiens; identical to SEQ ID NO: 537231
  misc_feature: HIJSMM301BZ3MP.19.67.G01.1.454.light.4.raw

SEQ ID NO: 539804 - DNA, 494 bp, Homo sapiens; identical to SEQ ID NO: 535478
  misc_feature: HIJSMM301A5BL9.10.79.H02.1.454.light.4.raw

SEQ ID NO: 539805 - DNA, 495 bp, Homo sapiens
  misc_feature: HIJSMM301DZXBJ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacggactggagattaaaggaactgtggctgcaccatctgtcttcatcttccccg

SEQ ID NO: 539806 - DNA, 516 bp, Homo sapiens
  misc_feature: HIJSMM301ANJVZ.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggcccgtcaccttcctacttcgtcggtcgggacggaacggacggtaggagaaacgaaacgaacgtaggtcggtcgtcgaccactactcgttcg

SEQ ID NO: 539807 - DNA, 503 bp, Homo sapiens; identical to SEQ ID NO: 535044
  misc_feature: HIJSMM301BQOGN.19.78.H01.1.454.light.4.raw

SEQ ID NO: 539808 - DNA, 472 bp, Homo sapiens
  misc_feature: HIJSMM301ARF5Y.13.59.F04.1.454.light.4.raw
tcacgtactacacgaccggtgctcgatttagtacacacacttagggattgggggcagaagtctctctcagtcaggacacagcatggacatgaggatccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaa

SEQ ID NO: 539809 - DNA, 495 bp, Homo sapiens
  misc_feature: HIJSMM301C7BQ2.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgcctcctcgagtgcgtct

SEQ ID NO: 539810 - DNA, 486 bp, Homo sapiens; identical to SEQ ID NO: 536555
  misc_feature: HIJSMM301D020Y.26.23.C01.1.454.light.4.raw

SEQ ID NO: 539811 - DNA, 511 bp, Homo sapiens
  misc_feature: HIJSMM301DJHLH.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggcgctcactttcgcggagggacgaacggtaggagagtcaaacgaaactagtggcgtgcaccactctgtt

SEQ ID NO: 539812 - DNA, 486 bp, Homo sapiens; identical to SEQ ID NO: 535917
  misc_feature: HIJSMM301AVHGC.3.10.A10.1.454.light.4.raw

SEQ ID NO: 539813 - DNA, 512 bp, Homo sapiens
  misc_feature: HIJSMM301D9EQQ.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaagg

SEQ ID NO: 539814 - DNA, 514 bp, Homo sapiens
  misc_feature: HIJSMM301BVI88.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccct

SEQ ID NO: 539815 - DNA, 492 bp, Homo sapiens
  misc_feature: HIJSMM301ESELK.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 539816 - DNA, 422 bp, Homo sapiens; identical to SEQ ID NO: 539229
  misc_feature: HIJSMM301B53C6.41.15.B04.1.454.light.4.raw

SEQ ID NO: 539817 - DNA, 507 bp, Homo sapiens
  misc_feature: HIJSMM301ELB99.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 539818 - DNA, 440 bp, Homo sapiens
  misc_feature: HIJSMM301A9OEG.4.22.B11.1.454.light.4.raw
agcactgtagcacgaccggtgctcgatttagacgacagctcaggggtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccatctgtcttcatcttcctgccatctgactacagtgct

SEQ ID NO: 539819 - DNA, 470 bp, Homo sapiens
  misc_feature: HIJSMM301BJH8C.19.74.G08.1.454.light.4.raw
tactctcgtgcacgaccggtgctcgatttagtagctctatcagggtgctgctaatgctctgggcccctggatccagtggggatattgtgatgacccaggctccactctcctcacctgtcacccttggacagccggcctccatctcctgcacttctagccaaaacctcgtgcacagtgatggaaacacctacttgagttggcttcagcagaggccaggccagcctccaagactcctaatctctaagatttctaaccggttctctggggtcccagacagattcagtggcagtggggcaggggcagatttcacactgagaatcagcagggtggaacctgaggatgtcgcgatttattactgcatgcaagctacacattttcctcgaacttttggccaggggaccaggctggagatcaagcgaactgtggctgcaccatctgtcttcatcttcccgccatctgacacgagagta

SEQ ID NO: 539820 - DNA, 447 bp, Homo sapiens; identical to SEQ ID NO: 535201
  misc_feature: HIJSMM301EUP2F.18.9.A09.1.454.light.4.raw

SEQ ID NO: 539821 - DNA, 519 bp, Homo sapiens
  misc_feature: HIJSMM301BAJ65.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatacaaccgaactgtggctgcaccatctgtcttcatcttccccg

SEQ ID NO: 539822 - DNA, 496 bp, Homo sapiens
  misc_feature: HIJSMM301CV962.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgcatctgac

SEQ ID NO: 539823 - DNA, 506 bp, Homo sapiens; identical to SEQ ID NO: 538849
  misc_feature: HIJSMM301DGM0V.43.15.B04.1.454.light.4.raw

SEQ ID NO: 539824 - DNA, 488 bp, Homo sapiens; identical to SEQ ID NO: 536742
  misc_feature: HIJSMM301ARL3T.3.72.G06.1.454.light.4.raw

SEQ ID NO: 539825 - DNA, 502 bp, Homo sapiens
  misc_feature: HIJSMM301A20ZA.18.26.C04.1.454.light.4.raw
tacgagtatgcacgaccggtgctcgatttagtctagcgactttggggtttggggggtcgagacccacgtcgggacgacagcatggacatgagggtccccgcctcagctcctggggcgtcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaggtggacatcaagcgaactgtggctgcaccatctgtcttcatcttcccg

SEQ ID NO: 539826 - DNA, 486 bp, Homo sapiens
  misc_feature: HIJSMM301D9Q3P.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaacgaactgtggctgcaccat

SEQ ID NO: 539827 - DNA, 509 bp, Homo sapiens
  misc_feature: HIJSMM301BGVSB.9.12.B01.1.454.light.4.raw
  modified_base (480)..(480): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttctcgggcgttcggccaagggaccaacggtaggaaatacgaaacgaactagtggngtgcaccatctgtcttctactcttccccg

SEQ ID NO: 539828 - DNA, 502 bp, Homo sapiens
  misc_feature: HIJSMM301B88IY.9.71.G05.1.454.light.4.raw
tgatacgtctcacgaccggtgctcgatttagtgtcgtcgcaagagagaggggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggaggaccaggctgaccgtcctgagtcagcccaaggctgcccccc

SEQ ID NO: 539829 - DNA, 517 bp, Homo sapiens
  misc_feature: HIJSMM301BBY01.43.81.H04.1.454.light.4.raw
tgtgagtagtcacgaccggtgctcgatttagtagtgtagattcgcggggctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctgttcccaccctcctcacta

SEQ ID NO: 539830 - DNA, 501 bp, Homo sapiens
  misc_feature: HIJSMM301CA0VB.2.76.G10.1.454.light.4.raw
acgctcgacacacgaccggtgctcgatttagtcactcatacagggggagagatctggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 539831 - DNA, 506 bp, Homo sapiens; identical to SEQ ID NO: 534969
  misc_feature: HIJSMM301BR4VM.18.37.D04.1.454.light.4.raw

SEQ ID NO: 539832 - DNA, 509 bp, Homo sapiens
  misc_feature: HIJSMM301AKN0V.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtggaaagtacaaacgaacctagtggctgcaccatctgtcttctatcttccccg

SEQ ID NO: 539833 - DNA, 479 bp, Homo sapiens; identical to SEQ ID NO: 537163
  misc_feature: HIJSMM301EGIXG.13.73.G07.1.454.light.4.raw

SEQ ID NO: 539834 - DNA, 503 bp, Homo sapiens; identical to SEQ ID NO: 536834
  misc_feature: HIJSMM301DPM0S.2.35.D02.1.454.light.4.raw

SEQ ID NO: 539835 - DNA, 484 bp, Homo sapiens
  misc_feature: HIJSMM301B8OD7.40.81.H04.1.454.light.4.raw
tctagcgactcacgaccggtgctcgatttagtagtgtagattcgcggggtgatctgatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaatcaagcgaa

SEQ ID NO: 539836 - DNA, 495 bp, Homo sapiens
  misc_feature: HIJSMM301B6U6U.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgaactggagattaaaggaactgtggctgcaccatctgtcttcatcttccccg

SEQ ID NO: 539837 - DNA, 497 bp, Homo sapiens
  misc_feature: HIJSMM301AS3OB.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactgggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgtt

SEQ ID NO: 539838 - DNA, 463 bp, Homo sapiens; identical to SEQ ID NO: 535008
  misc_feature: HIJSMM301BPFB3.10.9.A09.1.454.light.4.raw

SEQ ID NO: 539839 - DNA, 492 bp, Homo sapiens
  misc_feature: HIJSMM301D9MIR.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccagccaccctgtctttatctccgggggaaagagccaccttctcctgcagggccagtcagagtgttagcatctacttagcctggtaccaacaaagacctggccaggctcccaggctcctcatctatgatgcatccaccagggccactggcatcccagacaggttcagtggcagtgggtctgggacagacttcactctcaccatcagcagcctagagcctgaagattttggcgtttattactgtcagcagcgtgacagttggcctgcgcacagctttggccaggggaccaagctggaggtcaaacgaactgtggctgcaccatctgtcttcat

SEQ ID NO: 539840 - DNA, 488 bp, Homo sapiens
  misc_feature: HIJSMM301EC92E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctggaacagatttcactctcaccgtcagcagtctgcaacctgaagattttgcaacttactactgtcaacagagttacagtacccccctcactttcggcggaggaccaaggcggagatcagacgaactgtggctgcaccatctgtcttcta

SEQ ID NO: 539841 - DNA, 485 bp, Homo sapiens; identical to SEQ ID NO: 535606
  misc_feature: HIJSMM301AXT9V.47.46.E02.1.454.light.4.raw

SEQ ID NO: 539842 - DNA, 479 bp, Homo sapiens; identical to SEQ ID NO: 535188
  misc_feature: HIJSMM301AW18M.10.74.G08.1.454.light.4.raw

SEQ ID NO: 539843 - DNA, 493 bp, Homo sapiens
  misc_feature: HIJSMM301D133U.49.66.F11.1.454.light.4.raw
agtcgagagacacgaccggtgctcgatttagtcacgcgagaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtacacaggattcactttcggccctgggaccagagtggatatcaaacgaactgtggctgcaccatctgtcttcatcttcccg

SEQ ID NO: 539844 - DNA, 488 bp, Homo sapiens; identical to SEQ ID NO: 535990
  misc_feature: HIJSMM301AMO36.11.28.C06.1.454.light.4.raw

SEQ ID NO: 539845 - DNA, 453 bp, Homo sapiens
  misc_feature: HIJSMM301BBHP4.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagaga

SEQ ID NO: 539846 - DNA, 491 bp, Homo sapiens
  misc_feature: HIJSMM301C2HJM.10.72.G06.1.454.light.4.raw
catagtagtgcacgaccggtgctcgatttagctacgactgcaagggaaaggggggtctcaggaggcagtgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 539847 - DNA, 508 bp, Homo sapiens; identical to SEQ ID NO: 535649
  misc_feature: HIJSMM301DP1A6.47.55.E11.1.454.light.4.raw

SEQ ID NO: 539848 - DNA, 483 bp, Homo sapiens
  misc_feature: HIJSMM301BGANN.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtgagatcaaacgaa

SEQ ID NO: 539849 - DNA, 496 bp, Homo sapiens; identical to SEQ ID NO: 535109
  misc_feature: HIJSMM301EIIW8.16.78.H01.1.454.light.4.raw

SEQ ID NO: 539850 - DNA, 484 bp, Homo sapiens
  misc_feature: HIJSMM301C6SZY.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagttccagaaaggttcagtggcagcgggtcagggacagatttcacactgaaaatcagccgggtggggctgaggatgttggcatttattactgcatgcaggctatacaccttcctgccacttttggccagggaccaagctggagatcaggcgaa

SEQ ID NO: 539851 - DNA, 501 bp, Homo sapiens; identical to SEQ ID NO: 535746
  misc_feature: HIJSMM301C6V0P.18.11.A11.1.454.light.4.raw

SEQ ID NO: 539852 - DNA, 474 bp, Homo sapiens; identical to SEQ ID NO: 535264
  misc_feature: HIJSMM301AX482.13.76.G10.1.454.light.4.raw

SEQ ID NO: 539853 - DNA, 486 bp, Homo sapiens; identical to SEQ ID NO: 535523
  misc_feature: HIJSMM301AVXEI.22.73.G07.1.454.light.4.raw

SEQ ID NO: 539854 - DNA, 491 bp, Homo sapiens
  misc_feature: HIJSMM301A3GXF.51.9.A09.1.454.light.4.raw
cgatcgtatacacgaccggtgctcgatttagcgagacgcgcaggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgatttggcacagcagcgcttgggtattcggcggggggaccgaaactgaccgtcctaggtcagcccaacggc

SEQ ID NO: 539855 - DNA, 474 bp, Homo sapiens
  misc_feature: HIJSMM301BLOP7.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatacaacgaaa

SEQ ID NO: 539856 - DNA, 502 bp, Homo sapiens
  misc_feature: HIJSMM301AY8AY.48.29.C07.1.454.light.4.raw
agtatacatacacgaccggtgctcgatttagagtgctacgaagggaaagggggtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttccccg

SEQ ID NO: 539857 - DNA, 477 bp, Homo sapiens
  misc_feature: HIJSMM301EKXE6.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcacttctccgtccctaccctcctactactacgtctacgtagcggcggcgtcgacgacggcg

SEQ ID NO: 539858 - DNA, 511 bp, Homo sapiens
  misc_feature: HIJSMM301B1YUP.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcct

SEQ ID NO: 539859 - DNA, 440 bp, Homo sapiens
  misc_feature: HIJSMM301EDSS8.11.3.A03.1.454.light.4.raw
  modified_base (423)..(423): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccncctcctcgtatctctcg

SEQ ID NO: 539860 - DNA, 484 bp, Homo sapiens
  misc_feature: HIJSMM301DJ204.48.60.F05.1.454.light.4.raw
agtatacatacacgaccggtgctcgatttagtacgtcatcaggggactgatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtgg

SEQ ID NO: 539861 - DNA, 446 bp, Homo sapiens; identical to SEQ ID NO: 537330
  misc_feature: HIJSMM301CXS9V.18.9.A09.1.454.light.4.raw

SEQ ID NO: 539862 - DNA, 463 bp, Homo sapiens; identical to SEQ ID NO: 536878
  misc_feature: HIJSMM301COPD3.26.78.H01.1.454.light.4.raw

SEQ ID NO: 539863 - DNA, 427 bp, Homo sapiens
  misc_feature: HIJSMM301ANHLL.41.38.D05.1.454.light.4.raw
tctatactatcacgaccggtgctcgatttagtatctgatagttgggtttgggggctcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgcccctcggtcactctgttcccgccctcctcatagtataga

SEQ ID NO: 539864 - DNA, 503 bp, Homo sapiens; identical to SEQ ID NO: 537189
  misc_feature: HIJSMM301AU1Z2.19.85.H08.1.454.light.4.raw

SEQ ID NO: 539865 - DNA, 494 bp, Homo sapiens
  misc_feature: HIJSMM301BQYDI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagactcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 539866 - DNA, 509 bp, Homo sapiens
  misc_feature: HIJSMM301C803G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccctccctctacgttcggacggacggacgaaggacggagatacgacgaacgtaacgtggtcggcgtcgaccaacctatccttgttcctt

SEQ ID NO: 539867 - DNA, 515 bp, Homo sapiens
  misc_feature: HIJSMM301CTQ6R.13.53.E09.1.454.light.4.raw
  modified_base (498)..(498): a, c, t, g, unknown or other
tcacgtactacacgaccggtgctcgatttagagagagtgtgttgggtttgggggaggtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccgacggaccgaacggtaggaatacaagacgaactacgtggcgtgcaccaactcgttntcttctactcttcccgt

SEQ ID NO: 539868 - DNA, 500 bp, Homo sapiens
  misc_feature: HIJSMM301B4U9U.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgctagtttattactgtcagcagtataataactggcctcggacgttcggccgaaggaccgaaggtaggaagtcaaacgaactagtggctgcaccatctgtcttctactcttcccgt

SEQ ID NO: 539869 - DNA, 490 bp, Homo sapiens
  misc_feature: HIJSMM301BQD01.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaagctgacagtcctaggtcagcccaaggctgcccccc

SEQ ID NO: 539870 - DNA, 488 bp, Homo sapiens; identical to SEQ ID NO: 537260
  misc_feature: HIJSMM301D85I5.47.70.G04.1.454.light.4.raw

SEQ ID NO: 539871 - DNA, 447 bp, Homo sapiens; identical to SEQ ID NO: 535201
  misc_feature: HIJSMM301BP4QX.18.9.A09.1.454.light.4.raw

SEQ ID NO: 539872 - DNA, 461 bp, Homo sapiens
  misc_feature: HIJSMM301C7HDU.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggtttttggtcggagggaccaaggctgaccgtcctaggtcagcccaaggctgcccctcggtcactctgttcccgccctcctcgtatctctcg

SEQ ID NO: 539873 - DNA, 486 bp, Homo sapiens
  misc_feature: HIJSMM301C4KUR.52.27.C05.1.454.light.4.raw
cgcagtacgacacgaccggtgctcgatttagacgcgatcgaagggtttgggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtcccgtcaaggttcagtggccgtggatctgggacagatttcactctcaccatcagcagtctccaacctgaagattttgcaatttactactgtcaacagagtgacaatacccctcagactttcggccctggaccagagtggatatcaaacgaactgtggctgcaccatctgtcttcatt

SEQ ID NO: 539874 - DNA, 497 bp, Homo sapiens
  misc_feature: HIJSMM301AOBEF.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctcgggaccaaacgtggatttctagacgaactagtggctgcaccatctgtcttcta

SEQ ID NO: 539875 - DNA, 499 bp, Homo sapiens; identical to SEQ ID NO: 537739
  misc_feature: HIJSMM301CLOB3.12.86.H09.1.454.light.4.raw

SEQ ID NO: 539876 - DNA, 518 bp, Homo sapiens; identical to SEQ ID NO: 536231
  misc_feature: HIJSMM301DE51E.22.30.C08.1.454.light.4.raw

SEQ ID NO: 539877 - DNA, 497 bp, Homo sapiens
  misc_feature: HIJSMM301AZ1EK.48.86.H09.1.454.light.4.raw
  modified_base (252)..(252): a, c, t, g, unknown or other
agtatacatacacgaccggtgctcgatttagtgctatagacttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccacggacagacggccaggatcacgtgctctgcagagacgttgccaagtcaatttggttttttggtancagcagaagtcaggccaggccccaacgactgctcatgtatagagacagtgagaggtcctcagggagtccctgagcgattctctggctccagctctgggacgacactcactctgactatcagtgaagtccgggcgagaagacgaggctgactactattgtcagtcaggagacaatactcgcacgcaagtactgttcggcggagggaccaagctgacagtcctaggtcagcccaaggctgccccccg

SEQ ID NO: 539878 - DNA, 488 bp, Homo sapiens; identical to SEQ ID NO: 535081
  misc_feature: HIJSMM301CA03O.26.23.C01.1.454.light.4.raw

SEQ ID NO: 539879 - DNA, 507 bp, Homo sapiens
  misc_feature: HIJSMM301D6AUK.41.80.H03.1.454.light.4.raw
tctatactatcacgaccggtgctcgatttagctgtgcgtcgaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatttcgggtggttcgggcgggggaccgaagctcgaccgtcctaggtcagcccaaggctcgcccccgtcgtcgta

SEQ ID NO: 539880 - DNA, 501 bp, Homo sapiens; identical to SEQ ID NO: 535746
  misc_feature: HIJSMM301EE4RR.18.11.A11.1.454.light.4.raw

SEQ ID NO: 539881 - DNA, 493 bp, Homo sapiens
  misc_feature: HIJSMM301DWO64.52.86.H09.1.454.light.4.raw
cgcagtacgacacgaccggtgctcgatttagtgctatagacttgggtttggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 539882 - DNA, 502 bp, Homo sapiens
  misc_feature: HIJSMM301A61VN.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctcgtt

SEQ ID NO: 539883 - DNA, 383 bp, Homo sapiens; identical to SEQ ID NO: 536198
  misc_feature: HIJSMM301CBRFX.41.86.H09.1.454.light.4.raw

SEQ ID NO: 539884 - DNA, 488 bp, Homo sapiens
  misc_feature: HIJSMM301CGVA6.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 539885 - DNA, 447 bp, Homo sapiens; identical to SEQ ID NO: 535020
  misc_feature: HIJSMM301DBONL.18.9.A09.1.454.light.4.raw

SEQ ID NO: 539886 - DNA, 487 bp, Homo sapiens; identical to SEQ ID NO: 536206
  misc_feature: HIJSMM301C12F1.47.38.D05.1.454.light.4.raw

SEQ ID NO: 539887 - DNA, 305 bp, Homo sapiens
  misc_feature: HIJSMM301EFDGE.49.19.B08.1.454.light.4.raw
agtcgagagacacgaccggtgctcgatttagtgagtcagtaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccgccctcctctctctcgact

SEQ ID NO: 539888 - DNA, 496 bp, Homo sapiens
  misc_feature: HIJSMM301BPE7J.15.58.F03.1.454.light.4.raw
tctacgtagccacgaccggtgctcgatttagtctgatcgagaagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcacagcaactggttactctctttcggcggagggaccaaggtggagatcaaacgaactgtggctgcaccatctgtcttcta

SEQ ID NO: 539889 - DNA, 512 bp, Homo sapiens
  misc_feature: HIJSMM301CSTX4.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccacctcctcg

SEQ ID NO: 539890 - DNA, 475 bp, Homo sapiens
  misc_feature: HIJSMM301CIAAN.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccaaagtggatgtcaaccgaactgtggctgcacca

SEQ ID NO: 539891 - DNA, 486 bp, Homo sapiens
  misc_feature: HIJSMM301B3ZH4.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctcgggaccgaactgtggatatcaaacgaaactgtggctgcaccatctgtctt

SEQ ID NO: 539892 - DNA, 462 bp, Homo sapiens
  misc_feature: HIJSMM301BPXLU.49.22.B11.1.454.light.4.raw
agtcgagagacacgaccggtgctcgatttagacgacagctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaa

SEQ ID NO: 539893 - DNA, 484 bp, Homo sapiens; identical to SEQ ID NO: 535400
  misc_feature: HIJSMM301A7SVU.46.26.C04.1.454.light.4.raw

SEQ ID NO: 539894 - DNA, 494 bp, Homo sapiens
  misc_feature: HIJSMM301CTTDB.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgtggc

SEQ ID NO: 539895 - DNA, 502 bp, Homo sapiens
  misc_feature: HIJSMM301ALA92.43.60.F05.1.454.light.4.raw
tgtgagtagtcacgaccggtgctcgatttagtacgtcatcagggaaaggggaggtcagacccacctcaggacacagcatggacatgagggtccccggcctcagctcctggggcgtcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccggacggtcggagtgtcaacgacgaacgtagtggctcgcaccactcttcg

SEQ ID NO: 539896 - DNA, 491 bp, Homo sapiens; identical to SEQ ID NO: 538021
  misc_feature: HIJSMM301EJFSK.3.72.G06.1.454.light.4.raw

SEQ ID NO: 539897 - DNA, 501 bp, Homo sapiens
  misc_feature: HIJSMM301CLVG8.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcatttctgggcatctacccgggaatccggggtccctgagcgattcagtggcagcgggtctgggacagatttcactttcaccatcagcagcctgcaggctgaagatgtggcagtttattactgtcagcaatattatagtactcccttacaccttttggccaggggaccaagctggagatcaaacgaactgtggctgcacca

SEQ ID NO: 539898 - DNA, 444 bp, Homo sapiens; identical to SEQ ID NO: 535594
  misc_feature: HIJSMM301DK3O3.9.9.A09.1.454.light.4.raw

SEQ ID NO: 539899 - DNA, 479 bp, Homo sapiens
  misc_feature: HIJSMM301B3K3A.12.19.B08.1.454.light.4.raw
atacgacgtacacgaccggtgctcgatttagtgagtcagtaaggggcctgaagactttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgcagggcaagtcagaggattagcagttatttaaattggtgtcagcagaagccagggagagcccctaaggtcctgatctatgcttcatccagtttgcaaagtggggtcccatcaaggttcagtggcagtggatctgggacagatttcactctcaccatcagcggtctgcaacctgaagattttgcaacttacttctgtcaacagagttacaatacccctccgtcacctgcggccaagggacacgg

SEQ ID NO: 539900 - DNA, 481 bp, Homo sapiens; identical to SEQ ID NO: 539249
  misc_feature: HIJSMM301CKBAZ.11.76.G10.1.454.light.4.raw

SEQ ID NO: 539901 - DNA, 497 bp, Homo sapiens; identical to SEQ ID NO: 536376
  misc_feature: HIJSMM301CO6XN.22.9.A09.1.454.light.4.raw

SEQ ID NO: 539902 - DNA, 520 bp, Homo sapiens; identical to SEQ ID NO: 537173
  misc_feature: HIJSMM301D1BDV.27.23.C01.1.454.light.4.raw

SEQ ID NO: 539903 - DNA, 497 bp, Homo sapiens
  misc_feature: HIJSMM301AYCJ2.11.71.G05.1.454.light.4.raw
cgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 539904 - DNA, 498 bp, Homo sapiens
  misc_feature: HIJSMM301BQCJX.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaacggtggaagtcagacgaactgtggctgcaccatctgtcttcatt

SEQ ID NO: 539905 - DNA, 494 bp, Homo sapiens
  misc_feature: HIJSMM301B4B9P.27.78.H01.1.454.light.4.raw
  modified_base (432)..(432): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtnatcaccttcggccaagggacacgactggagattaaacgaactgtggctgcaccatctgtctt

SEQ ID NO: 539906 - DNA, 514 bp, Homo sapiens
  misc_feature: HIJSMM301AWSBY.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcg

SEQ ID NO: 539907 - DNA, 485 bp, Homo sapiens; identical to SEQ ID NO: 539315
  misc_feature: HIJSMM301AK0YS.3.88.H11.1.454.light.4.raw

SEQ ID NO: 539908 - DNA, 505 bp, Homo sapiens
  misc_feature: HIJSMM301EMGXQ.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctggggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcc

SEQ ID NO: 539909 - DNA, 494 bp, Homo sapiens
  misc_feature: HIJSMM301A71KI.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttca

SEQ ID NO: 539910 - DNA, 486 bp, Homo sapiens; identical to SEQ ID NO: 535043
  misc_feature: HIJSMM301AUBVO.46.35.D02.1.454.light.4.raw

SEQ ID NO: 539911 - DNA, 508 bp, Homo sapiens
  misc_feature: HIJSMM301DQ5FC.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccgggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgccat

SEQ ID NO: 539912 - DNA, 494 bp, Homo sapiens
  misc_feature: HIJSMM301ANJNZ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgccgaagggaccgaaagtaggacgatcaagcgaactagtggctgcaccatctgtt

SEQ ID NO: 539913 - DNA, 512 bp, Homo sapiens
  misc_feature: HIJSMM301EW8UF.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgtatcaccttccgtccgaacggaacggacgacgtacggaggagttaaacgtaaacgtaacgttggcgtcgcacccaactactgttc

SEQ ID NO: 539914 - DNA, 501 bp, Homo sapiens
  misc_feature: HIJSMM301C3JY2.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccactgtca

SEQ ID NO: 539915 - DNA, 454 bp, Homo sapiens; identical to SEQ ID NO: 535005
  misc_feature: HIJSMM301B47LI.19.86.H09.1.454.light.4.raw

SEQ ID NO: 539916 - DNA, 492 bp, Homo sapiens
  misc_feature: HIJSMM301BQECG.41.59.F04.1.454.light.4.raw
tctatactatcacgaccggtgctcgatttagtacacacacttagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgtcaacaggctaataggttccctcaaacattcggccctgggaccagagtggatttgaagcgaactgtggctgcaccatctgtt

SEQ ID NO: 539917 - DNA, 506 bp, Homo sapiens
  misc_feature: HIJSMM301CLJHF.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtgaggatcaaacgaactgtggctgcaccatctgtt

SEQ ID NO: 539918 - DNA, 530 bp, Homo sapiens
  misc_feature: HIJSMM301EBDFP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacagttttctcggggcgtcggtccgaacgggaccgaaaggtagggtaaaagtaacgaaaacgaaaccgtaagttaggacgtggcaccaatctgtcttctactcttccccg

SEQ ID NO: 539919 - DNA, 482 bp, Homo sapiens
  misc_feature: HIJSMM301AUIGM.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttctaccatcagcagcctgcagcctgaagatattgcaacatattactgtcagcagtatgataatctcccgactcaccttcggtcccaagggacacgactggaggattaaacgaaactgtggctgcacca

SEQ ID NO: 539920 - DNA, 476 bp, Homo sapiens
  misc_feature: HIJSMM301AT4XL.5.15.B04.1.454.light.4.raw
atcagacacgcacgaccggtgctcgatttagacagtatatatccgcggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactgtggctgcacca

SEQ ID NO: 539921 - DNA, 498 bp, Homo sapiens; identical to SEQ ID NO: 537020
  misc_feature: HIJSMM301B9JZY.26.26.C04.1.454.light.4.raw

SEQ ID NO: 539922 - DNA, 494 bp, Homo sapiens
  misc_feature: HIJSMM301BBTB5.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 539923 - DNA, 515 bp, Homo sapiens
  misc_feature: HIJSMM301BX99U.47.53.E09.1.454.light.4.raw
  modified_base (508)..(508): a, c, t, g, unknown or other
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctgccccctcggtcactctgttcccnccctcct

SEQ ID NO: 539924 - DNA, 507 bp, Homo sapiens
  misc_feature: HIJSMM301BMHTS.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctcgccccctcggt

SEQ ID NO: 539925 - DNA, 447 bp, Homo sapiens; identical to SEQ ID NO: 535201
  misc_feature: HIJSMM301DTYYQ.18.9.A09.1.454.light.4.raw

SEQ ID NO: 539926 - DNA, 506 bp, Homo sapiens
  misc_feature: HIJSMM301B5V9Q.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 539927 - DNA, 484 bp, Homo sapiens
  misc_feature: HIJSMM301C5TH5.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccgccctcctcgctacgtaga

SEQ ID NO: 539928 - DNA, 484 bp, Homo sapiens; identical to SEQ ID NO: 535240
  misc_feature: HIJSMM301AR0VQ.47.60.F05.1.454.light.4.raw

SEQ ID NO: 539929 - DNA, 487 bp, Homo sapiens
  misc_feature: HIJSMM301AS7AU.21.52.E08.1.454.light.4.raw
tcgtcgctcgcacgaccggtgctcgatttagtcgagctctcagagagaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtattttttacagccccaccaataagagctacttagcttggttccagcacaaaccaggacagcctcctgtaatgctcatttactgggcgtctacccgggaatatggggtccctgaccgattcagtggcagcgggtctgggacagatttcactctcaccatcagcagcctgcaggctgaagatgtggcagtttattactgtcagcaatattatatttctcctcagacgttcggccaagggaccagggtggaaatcaaacgaa

SEQ ID NO: 539930 - DNA, 487 bp, Homo sapiens
  misc_feature: HIJSMM301C10AZ.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtggatatcagacgaa

SEQ ID NO: 539931 - DNA, 450 bp, Homo sapiens
  misc_feature: HIJSMM301AP19P.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaacctcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctcctgtcactctgttcccgccctcctccatactcgta

SEQ ID NO: 539932 - DNA, 485 bp, Homo sapiens
  misc_feature: HIJSMM301EHV2G.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacagactaacagtttccctttaatcttcggccaagggacacgactggagattaaacgaactgtggctgcacca

SEQ ID NO: 539933 - DNA, 490 bp, Homo sapiens; identical to SEQ ID NO: 535936
  misc_feature: HIJSMM301APKT9.16.68.G02.1.454.light.4.raw

SEQ ID NO: 539934 - DNA, 460 bp, Homo sapiens; identical to SEQ ID NO: 539553
  misc_feature: HIJSMM301BH7MC.11.86.H09.1.454.light.4.raw

SEQ ID NO: 539935 - DNA, 465 bp, Homo sapiens
  misc_feature: HIJSMM301CWVOB.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcactactgtcaacagagtgacagcacgcctcacactttcggcggagggaccaaggtggagatcaaacgaa

SEQ ID NO: 539936 - DNA, 498 bp, Homo sapiens
  misc_feature: HIJSMM301DZIWH.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttacttcggtcggagggaccaaggtggagatcaacgaactgtggctgcaccatctgtcttcatcttccccg

SEQ ID NO: 539937 - DNA, 511 bp, Homo sapiens
  misc_feature: HIJSMM301CXKH4.14.7.A07.1.454.light.4.raw
cgtctagtaccacgaccggtgctcgatttagcacgtgtcgcagggggccctgaggaaaacaaaccccagctgggaagcctgagaacacttagcctgcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttgggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagcccaac

SEQ ID NO: 539938 - DNA, 486 bp, Homo sapiens
  misc_feature: HIJSMM301B6O3R.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttccccaccctcctcgctacgtaga

SEQ ID NO: 539939 - DNA, 495 bp, Homo sapiens; identical to SEQ ID NO: 538269
  misc_feature: HIJSMM301EPAZ9.9.1.A01.1.454.light.4.raw

SEQ ID NO: 539940 - DNA, 501 bp, Homo sapiens
  misc_feature: HIJSMM301BKBGT.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggc

SEQ ID NO: 539941 - DNA, 500 bp, Homo sapiens
  misc_feature: HIJSMM301BB4ZX.18.26.C04.1.454.light.4.raw
tacgagtatgcacgaccggtgctcgatttagtctagcgactttgggtttggggggtcgagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttattactgccaacaatataatagtcattctcagacgttcggccaagggaccaaggtggaggtcaaacgaactgtggctgcaccatctgtcttcatcttcccgcc

SEQ ID NO: 539942 - DNA, 492 bp, Homo sapiens; identical to SEQ ID NO: 537509
  misc_feature: HIJSMM301DPDUA.13.46.E02.1.454.light.4.raw

SEQ ID NO: 539943 - DNA, 460 bp, Homo sapiens; identical to SEQ ID NO: 536053
  misc_feature: HIJSMM301EXHB9.22.28.C06.1.454.light.4.raw

SEQ ID NO: 539944 - DNA, 447 bp, Homo sapiens; identical to SEQ ID NO: 535882
  misc_feature: HIJSMM301EGAW6.18.9.A09.1.454.light.4.raw
  modified_base (429)..(429): a, c, t, g, unknown or other

SEQ ID NO: 539945 - DNA, 441 bp, Homo sapiens; identical to SEQ ID NO: 534971
  misc_feature: HIJSMM301C7UE7.11.3.A03.1.454.light.4.raw

SEQ ID NO: 539946 - DNA, 521 bp, Homo sapiens
  misc_feature: HIJSMM301D4JPA.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgt

SEQ ID NO: 539947 - DNA, 451 bp, Homo sapiens
  misc_feature: HIJSMM301E3I9X.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcacttcgttcgggcgggacgg

SEQ ID NO: 539948 - DNA, 486 bp, Homo sapiens; identical to SEQ ID NO: 535043
  misc_feature: HIJSMM301AZ6RJ.46.35.D02.1.454.light.4.raw

SEQ ID NO: 539949 - DNA, 490 bp, Homo sapiens
  misc_feature: HIJSMM301BIFCD.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaaggtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 539950 - DNA, 507 bp, Homo sapiens
  misc_feature: HIJSMM301DG46F.13.4.A04.1.454.light.4.raw
  modified_base (504)..(504): a, c, t, g, unknown or other
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactcngtt

SEQ ID NO: 539951 - DNA, 485 bp, Homo sapiens
  misc_feature: HIJSMM301AE86V.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaac

SEQ ID NO: 539952 - DNA, 484 bp, Homo sapiens; identical to SEQ ID NO: 535400
  misc_feature: HIJSMM301BH79G.46.26.C04.1.454.light.4.raw

SEQ ID NO: 539953 - DNA, 454 bp, Homo sapiens; identical to SEQ ID NO: 534964
  misc_feature: HIJSMM301CSS89.19.86.H09.1.454.light.4.raw

SEQ ID NO: 539954 - DNA, 479 bp, Homo sapiens; identical to SEQ ID NO: 538892
  misc_feature: HIJSMM301BF0WH.22.59.F04.1.454.light.4.raw

SEQ ID NO: 539955 - DNA, 501 bp, Homo sapiens
  misc_feature: HIJSMM301DXQV5.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccagggctgaagatcaggctgattattactgctgttcattttcaagttcctttttgtcttcggaactgggaccgaggtcaccgtcctaggtcagcccaaggccaacccca

SEQ ID NO: 539956 - DNA, 500 bp, Homo sapiens; identical to SEQ ID NO: 535310
  misc_feature: HIJSMM301BN3AB.47.66.F11.1.454.light.4.raw

SEQ ID NO: 539957 - DNA, 467 bp, Homo sapiens; identical to SEQ ID NO: 535997
  misc_feature: HIJSMM301BF7OB.5.36.D03.1.454.light.4.raw

SEQ ID NO: 539958 - DNA, 494 bp, Homo sapiens; identical to SEQ ID NO: 534994
  misc_feature: HIJSMM301E1BNF.27.78.H01.1.454.light.4.raw

SEQ ID NO: 539959 - DNA, 504 bp, Homo sapiens; identical to SEQ ID NO: 538423
  misc_feature: HIJSMM301AHK2G.48.67.G01.1.454.light.4.raw

SEQ ID NO: 539960 - DNA, 444 bp, Homo sapiens; identical to SEQ ID NO: 535594
  misc_feature: HIJSMM301ASGR5.9.9.A09.1.454.light.4.raw

SEQ ID NO: 539961 - DNA, 495 bp, Homo sapiens; identical to SEQ ID NO: 535821
  misc_feature: HIJSMM301AQKJM.3.31.C09.1.454.light.4.raw

SEQ ID NO: 539962 - DNA, 507 bp, Homo sapiens; identical to SEQ ID NO: 536874
  misc_feature: HIJSMM301EXK02.17.41.D08.1.454.light.4.raw

SEQ ID NO: 539963 - DNA, 489 bp, Homo sapiens
  misc_feature: HIJSMM301CIMWW.51.71.G05.1.454.light.4.raw
cgatcgtatacacgaccggtgctcgatttagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccca

SEQ ID NO: 539964 - DNA, 382 bp, Homo sapiens
  misc_feature: HIJSMM301EIL0Z.41.28.C06.1.454.light.4.raw
tctatactatcacgaccggtgctcgatttagagctcacgtattgggtttggggaaagagccaccctctcctgcagggccagtgagacagttactgtcaattacttagcctggtaccagcagaagcctggccaggctcccaggctcctcatctctgctgcttcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 539965 - DNA, 488 bp, Homo sapiens; identical to SEQ ID NO: 537260
  misc_feature: HIJSMM301DUWSI.47.70.G04.1.454.light.4.raw

SEQ ID NO: 539966 - DNA, 522 bp, Homo sapiens
  misc_feature: HIJSMM301BVL9F.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccaccct

SEQ ID NO: 539967 - DNA, 487 bp, Homo sapiens
  misc_feature: HIJSMM301BM44R.13.36.D03.1.454.light.4.raw
tcacgtactacacgaccggtgctcgatttagctgcgtcacgatctctcttgggggggtcgagagctctggggagggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 539968 - DNA, 499 bp, Homo sapiens
  misc_feature: HIJSMM301AD7I9.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggaggggaccaaggtggagatcaaacgaactgtggctgc

SEQ ID NO: 539969 - DNA, 447 bp, Homo sapiens; identical to SEQ ID NO: 535201
  misc_feature: HIJSMM301CAWAW.18.9.A09.1.454.light.4.raw

SEQ ID NO: 539970 - DNA, 495 bp, Homo sapiens; identical to SEQ ID NO: 535596
  misc_feature: HIJSMM301DUHNP.10.79.H02.1.454.light.4.raw

SEQ ID NO: 539971 - DNA, 444 bp, Homo sapiens
  misc_feature: HIJSMM301DIOPM.8.73.G07.1.454.light.4.raw
  modified_base (426)..(426): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccnccctcctcgacacgcgag

SEQ ID NO: 539972 - DNA, 507 bp, Homo sapiens; identical to SEQ ID NO: 535355
  misc_feature: HIJSMM301DXSBU.9.12.B01.1.454.light.4.raw

SEQ ID NO: 539973 - DNA, 498 bp, Homo sapiens
  misc_feature: HIJSMM301CTCJ0.52.86.H09.1.454.light.4.raw
cgcagtacgacacgaccggtgctcgatttagtgctatagacttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcta

SEQ ID NO: 539974 - DNA, 490 bp, Homo sapiens
  misc_feature: HIJSMM301DY158.3.19.B08.1.454.light.4.raw
agacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttcta

SEQ ID NO: 539975 - DNA, 505 bp, Homo sapiens
  misc_feature: HIJSMM301EOBF1.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccaggcccctcatctttgatgcatccatcagggccactggcatcccagccaggttcagtggcagtgggtctgggacagacttcactctcaccatcagcagcctagagcctgaagtattttgctagtttattactgtcaacatcgtaccgagtggccgtccgggggccacgttccggccctcgggaaccaaattgagatacaaacgaactgtggctgcaccatctgtctt

SEQ ID NO: 539976 - DNA, 503 bp, Homo sapiens
  misc_feature: HIJSMM301CT5HQ.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccaccctcctcta

SEQ ID NO: 539977 - DNA, 477 bp, Homo sapiens
  misc_feature: HIJSMM301C76JR.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggaggaccgcggtggagatcagacgaactgtggctgcaccatctgtctt

SEQ ID NO: 539978 - DNA, 505 bp, Homo sapiens
  misc_feature: HIJSMM301DSOFD.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 539979 - DNA, 447 bp, Homo sapiens; identical to SEQ ID NO: 535201
  misc_feature: HIJSMM301AVK3V.18.9.A09.1.454.light.4.raw

SEQ ID NO: 539980 - DNA, 511 bp, Homo sapiens
  misc_feature: HIJSMM301CWXT3.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctggtcagcccaaggctgccccctcggtcactctgttcccgccct

SEQ ID NO: 539981 - DNA, 519 bp, Homo sapiens
  misc_feature: HIJSMM301BT1JM.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 539982 - DNA, 503 bp, Homo sapiens; identical to SEQ ID NO: 538884
  misc_feature: HIJSMM301C0ZHE.27.78.H01.1.454.light.4.raw

SEQ ID NO: 539983 - DNA, 490 bp, Homo sapiens
  misc_feature: HIJSMM301BAI5V.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtggagggaccaaggtggaggtcaaacgaactgtggctgcaccatctgtcttcatt

SEQ ID NO: 539984 - DNA, 499 bp, Homo sapiens
  misc_feature: HIJSMM301D9MLZ.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgtagttgacacagccaccctcggtgtcagtgtccccacggacagacggccaggatcacctgctcttcagatgcattgccaaggcaatatgcttcttggtaccagcagaagccaggccaggcccctcgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccta

SEQ ID NO: 539985 - DNA, 497 bp, Homo sapiens
  misc_feature: HIJSMM301B166L.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagttcccgctcaccttcggtcgggggaccggaacggtaggaggagtacaaacgaaaaccgtaagttggcgtgcaccaact

SEQ ID NO: 539986 - DNA, 480 bp, Homo sapiens; identical to SEQ ID NO: 535291
  misc_feature: HIJSMM301BWKI4.22.59.F04.1.454.light.4.raw

SEQ ID NO: 539987 - DNA, 486 bp, Homo sapiens
  misc_feature: HIJSMM301B7EA3.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacga

SEQ ID NO: 539988 - DNA, 494 bp, Homo sapiens; identical to SEQ ID NO: 536477
  misc_feature: HIJSMM301BR8DM.22.5.A05.1.454.light.4.raw

SEQ ID NO: 539989 - DNA, 454 bp, Homo sapiens; identical to SEQ ID NO: 536449
  misc_feature: HIJSMM301CEBTA.18.78.H01.1.454.light.4.raw

SEQ ID NO: 539990 - DNA, 487 bp, Homo sapiens; identical to SEQ ID NO: 536206
  misc_feature: HIJSMM301BMRU7.47.38.D05.1.454.light.4.raw

SEQ ID NO: 539991 - DNA, 503 bp, Homo sapiens; identical to SEQ ID NO: 535073
  misc_feature: HIJSMM301CIST5.13.81.H04.1.454.light.4.raw

SEQ ID NO: 539992 - DNA, 495 bp, Homo sapiens
  misc_feature: HIJSMM301C5C7Y.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaac

SEQ ID NO: 539993 - DNA, 491 bp, Homo sapiens; identical to SEQ ID NO: 535194
  misc_feature: HIJSMM301CN1SO.26.78.H01.1.454.light.4.raw

SEQ ID NO: 539994 - DNA, 485 bp, Homo sapiens; identical to SEQ ID NO: 535880
  misc_feature: HIJSMM301EHRBF.7.75.G09.1.454.light.4.raw

SEQ ID NO: 539995 - DNA, 385 bp, Homo sapiens; identical to SEQ ID NO: 538634
  misc_feature: HIJSMM301B7HYK.12.41.D08.1.454.light.4.raw

SEQ ID NO: 539996 - DNA, 454 bp, Homo sapiens; identical to SEQ ID NO: 536449
  misc_feature: HIJSMM301DNQYB.18.78.H01.1.454.light.4.raw

SEQ ID NO: 539997 - DNA, 485 bp, Homo sapiens
  misc_feature: HIJSMM301DCS5C.19.71.G05.1.454.light.4.raw
tactctcgtgcacgaccggtgctcgatttagtgtcgtcgcaagagagaggggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaaggaccaaggtggatatcagacgaa

SEQ ID NO: 539998 - DNA, 444 bp, Homo sapiens; identical to SEQ ID NO: 535027
  misc_feature: HIJSMM301D8KTP.8.73.G07.1.454.light.4.raw

SEQ ID NO: 539999 - DNA, 513 bp, Homo sapiens
  misc_feature: HIJSMM301A0T04.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaacccactgtcact

SEQ ID NO: 540000 - DNA, 509 bp, Homo sapiens
  misc_feature: HIJSMM301BTI1T.48.87.H10.1.454.light.4.raw
agtatacatacacgaccggtgctcgatttagcagtactgcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctggtcagcccaaggctgccccctcggtcactctgttcccacct

SEQ ID NO: 540001 - DNA, 486 bp, Homo sapiens; identical to SEQ ID NO: 535917
  misc_feature: HIJSMM301CQ2EH.3.10.A10.1.454.light.4.raw

SEQ ID NO: 540002 - DNA, 505 bp, Homo sapiens
  misc_feature: HIJSMM301EV8HQ.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaacgaactgtggctgcaccatctgtcttcatt

SEQ ID NO: 540003 - DNA, 508 bp, Homo sapiens; identical to SEQ ID NO: 535649
  misc_feature: HIJSMM301C3ZAR.47.55.E11.1.454.light.4.raw

SEQ ID NO: 540004 - DNA, 516 bp, Homo sapiens
  misc_feature: HIJSMM301BAZWA.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccccggacgttcggtccaacgggaccgaacggtaggaaagtacaagacgaacgtacgtggcgtgcgaccactctcgtcttctatt

SEQ ID NO: 540005 - DNA, 500 bp, Homo sapiens; identical to SEQ ID NO: 536183
  misc_feature: HIJSMM301C6470.10.17.B06.1.454.light.4.raw

SEQ ID NO: 540006 - DNA, 489 bp, Homo sapiens
  misc_feature: HIJSMM301D2CAU.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctggtcactc

SEQ ID NO: 540007 - DNA, 454 bp, Homo sapiens; identical to SEQ ID NO: 534964
  misc_feature: HIJSMM301CSS3R.19.86.H09.1.454.light.4.raw

SEQ ID NO: 540008 - DNA, 485 bp, Homo sapiens
  misc_feature: HIJSMM301C77IR.5.41.D08.1.454.light.4.raw
atcagacacgcacgaccggtgctcgatttagtcacgcgagaaagggaaaggggctgatcaggactcctcagttcaccttctcacaatgaggctccctgctcagctcctggggctgctaatgctctgggtctctggatccagtggggagattgtgctgactcagtctccactctccctgtccgtcacccctggagagccggcctccatctcctgcaggtctagtcagagcctcctgcatagtaatggattcaactatttggattggtacctgcagaggccagggcagtctccacagctcctggtctatttgggctcttatcgggcctccggggtccctgagaggttcagtggcagtggatcaggcacagactttacactgcgaatcagcagagtggaggctgaggatgttggggtttattactgcatgcaagctctacaaaccctattcactttcggccctgggaccagagtggatatcaaacgaa

SEQ ID NO: 540009 - DNA, 494 bp, Homo sapiens; identical to SEQ ID NO: 535090
  misc_feature: HIJSMM301ALCRR.27.78.H01.1.454.light.4.raw
  modified_base (403)..(403): a, c, t, g, unknown or other

SEQ ID NO: 540010 - DNA, 497 bp, Homo sapiens
  misc_feature: HIJSMM301C2JGP.16.68.G02.1.454.light.4.raw
tgtactactccacgaccggtgctcgatttagtcgatagtgaagggaaaggggaggtcagacccacgtcaggacacagcatggacatgagggtccccgcctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgtcaacttattactgccaacagtatcatcatcattgtaatttcggttggagggaccaaaggtggagggacaaacgaactgtggctgcaccatctgtcttcatt

SEQ ID NO: 540011 - DNA, 487 bp, Homo sapiens; identical to SEQ ID NO: 537009
  misc_feature: HIJSMM301BJBT9.12.88.H11.1.454.light.4.raw

SEQ ID NO: 540012 - DNA, 500 bp, Homo sapiens
  misc_feature: HIJSMM301AFLD2.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 540013 - DNA, 468 bp, Homo sapiens
  misc_feature: HIJSMM301EGRSM.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccagtactcgta

SEQ ID NO: 540014 - DNA, 497 bp, Homo sapiens
  misc_feature: HIJSMM301A08MW.52.87.H10.1.454.light.4.raw
cgcagtacgacacgaccggtgctcgatttagcagtactgcgttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtca

SEQ ID NO: 540015 - DNA, 489 bp, Homo sapiens
  misc_feature: HIJSMM301B6Q40.17.57.F02.1.454.light.4.raw
cgtagactagcacgaccggtgctcgatttagctcgatatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatctcttgccgggcaagtcagagcattagcaactttttaaattggtatcagcgggaaccagggaaagcccctaaactcctgatctatactgcatccaatttgcaaagtggggtcccatcaaggttcagtggcagtggatctgggacagatttcactctcaccatcagcagtctgcaacctgaggattttgcaacttactactgtcaacagggttacagtacccccgtacacttttggccaggggaccaagctggagatcaaacgaactgtggctgcaccat

SEQ ID NO: 540016 - DNA, 520 bp, Homo sapiens
  misc_feature: HIJSMM301BLIVX.41.19.B08.1.454.light.4.raw
  modified_base (513)..(513): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccnccctcct

SEQ ID NO: 540017 - DNA, 494 bp, Homo sapiens; identical to SEQ ID NO: 534994
  misc_feature: HIJSMM301D9FJZ.27.78.H01.1.454.light.4.raw

SEQ ID NO: 540018 - DNA, 448 bp, Homo sapiens
  misc_feature: HIJSMM301B0MD3.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgaccctcctccatactcgta

SEQ ID NO: 540019 - DNA, 486 bp, Homo sapiens; identical to SEQ ID NO: 535043
  misc_feature: HIJSMM301BZDHF.46.35.D02.1.454.light.4.raw

SEQ ID NO: 540020 - DNA, 505 bp, Homo sapiens; identical to SEQ ID NO: 535503
  misc_feature: HIJSMM301BQCL9.8.28.C06.1.454.light.4.raw

SEQ ID NO: 540021 - DNA, 478 bp, Homo sapiens; identical to SEQ ID NO: 535129
  misc_feature: HIJSMM301A4IEZ.11.11.A11.1.454.light.4.raw

SEQ ID NO: 540022 - DNA, 493 bp, Homo sapiens
  misc_feature: HIJSMM301AQT6U.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccaaggaccgaaggtggaagtcaaacgaactagtggctgcaccatctgtctt

SEQ ID NO: 540023 - DNA, 506 bp, Homo sapiens
  misc_feature: HIJSMM301CN6EG.8.28.C06.1.454.light.4.raw
ctcgcgtgtccacgaccggtgctcgatttagagctcacgtattgggtttggggagagctctggggaggaactgctcagttaggacccagacggaaccatggaagccccagcgcagcttctcgtcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttca

SEQ ID NO: 540024 - DNA, 492 bp, Homo sapiens; identical to SEQ ID NO: 536087
  misc_feature: HIJSMM301DUA4E.10.17.B06.1.454.light.4.raw

SEQ ID NO: 540025 - DNA, 476 bp, Homo sapiens
  misc_feature: HIJSMM301EJPK4.4.32.C10.1.454.light.4.raw
agcactgtagcacgaccggtgctcgatttagtatagacatcaacacacaaagggggcaggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaagggaccaaggtggaaatcaaacgaactgt

SEQ ID NO: 540026 - DNA, 484 bp, Homo sapiens; identical to SEQ ID NO: 535400
  misc_feature: HIJSMM301EJ4BB.46.26.C04.1.454.light.4.raw

SEQ ID NO: 540027 - DNA, 487 bp, Homo sapiens
  misc_feature: HIJSMM301D51F9.52.25.C03.1.454.light.4.raw
cgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcacttttcggccctgggaccaaagtggacatcaaacgaactgtggctgcaccatct

SEQ ID NO: 540028 - DNA, 503 bp, Homo sapiens
  misc_feature: HIJSMM301A7WC5.48.58.F03.1.454.light.4.raw
agtatacatacacgaccggtgctcgatttagtctgatcgagaagggaaagggggcatgagcaaaactagacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgtcggaccttcggccaagggacacgactggagattaaacgaactgtggctgcaccatctgtcttcatcttccccg

SEQ ID NO: 540029 - DNA, 503 bp, Homo sapiens
  misc_feature: HIJSMM301ECZSM.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtt

SEQ ID NO: 540030 - DNA, 502 bp, Homo sapiens
  misc_feature: HIJSMM301AF5HO.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggc

SEQ ID NO: 540031 - DNA, 494 bp, Homo sapiens; identical to SEQ ID NO: 534994
  misc_feature: HIJSMM301DASKM.27.78.H01.1.454.light.4.raw

SEQ ID NO: 540032 - DNA, 500 bp, Homo sapiens
  misc_feature: HIJSMM301D0I5B.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggtcaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 540033 - DNA, 497 bp, Homo sapiens
  misc_feature: HIJSMM301BEFR3.52.51.E07.1.454.light.4.raw
cgcagtacgacacgaccggtgctcgatttagcatactctacaacacacaaagggggagctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccagggaccaaggtggagatcaacgaactgtggctgca

SEQ ID NO: 540034 - DNA, 445 bp, Homo sapiens; identical to SEQ ID NO: 537152
  misc_feature: HIJSMM301A66V3.5.9.A09.1.454.light.4.raw

SEQ ID NO: 540035 - DNA, 494 bp, Homo sapiens
  misc_feature: HIJSMM301A1EIY.41.54.E10.1.454.light.4.raw
tctatactatcacgaccggtgctcgatttagatcgtagcagaacacacaaaggggactgatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtgtttattactgcatgcaaggttcatattggccgtgcagttttggccaggggaccaagttggagatcaaacgaactgtgg

SEQ ID NO: 540036 - DNA, 485 bp, Homo sapiens; identical to SEQ ID NO: 536630
  misc_feature: HIJSMM301AXC3N.13.56.F01.1.454.light.4.raw

SEQ ID NO: 540037 - DNA, 447 bp, Homo sapiens; identical to SEQ ID NO: 535201
  misc_feature: HIJSMM301A5USH.18.9.A09.1.454.light.4.raw

SEQ ID NO: 540038 - DNA, 486 bp, Homo sapiens
  misc_feature: HIJSMM301AHEZJ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaacttcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 540039 - DNA, 496 bp, Homo sapiens; identical to SEQ ID NO: 535109
  misc_feature: HIJSMM301BURDZ.16.78.H01.1.454.light.4.raw

SEQ ID NO: 540040 - DNA, 481 bp, Homo sapiens
  misc_feature: HIJSMM301AQBR1.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgatttattattgccagtcctatgacaacaccctgcgtggttttggctgttcggcggcgggacc

SEQ ID NO: 540041 - DNA, 490 bp, Homo sapiens; identical to SEQ ID NO: 538273
  misc_feature: HIJSMM301AK4M1.16.73.G07.1.454.light.4.raw

SEQ ID NO: 540042 - DNA, 497 bp, Homo sapiens; identical to SEQ ID NO: 535664
  misc_feature: HIJSMM301BHD9P.22.14.B03.1.454.light.4.raw

SEQ ID NO: 540043 - DNA, 441 bp, Homo sapiens; identical to SEQ ID NO: 534971
  misc_feature: HIJSMM301BBW54.11.3.A03.1.454.light.4.raw

SEQ ID NO: 540044 - DNA, 494 bp, Homo sapiens; identical to SEQ ID NO: 535184
  misc_feature: HIJSMM301DQQV5.16.71.G05.1.454.light.4.raw

SEQ ID NO: 540045 - DNA, 509 bp, Homo sapiens
  misc_feature: HIJSMM301ALZSL.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccgaaggtggaagtcaagcgaactgtggctgcaccatctgtcttcatcttcccgcc

SEQ ID NO: 540046 - DNA, 447 bp, Homo sapiens; identical to SEQ ID NO: 535201
  misc_feature: HIJSMM301BQ6GD.18.9.A09.1.454.light.4.raw

SEQ ID NO: 540047 - DNA, 502 bp, Homo sapiens; identical to SEQ ID NO: 537363
  misc_feature: HIJSMM301BJZ9L.18.23.C01.1.454.light.4.raw

SEQ ID NO: 540048 - DNA, 492 bp, Homo sapiens; identical to SEQ ID NO: 538317
  misc_feature: HIJSMM301CQRR4.10.17.B06.1.454.light.4.raw

SEQ ID NO: 540049 - DNA, 494 bp, Homo sapiens
  misc_feature: HIJSMM301CM6UO.49.22.B11.1.454.light.4.raw
agtcgagagacacgaccggtgctcgatttagacgacagctcaggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgcat

SEQ ID NO: 540050 - DNA, 477 bp, Homo sapiens
  misc_feature: HIJSMM301DMNM3.7.67.G01.1.454.light.4.raw
  modified_base (463)..(463): a, c, t, g, unknown or other
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggngttcggcggaggga

SEQ ID NO: 540051 - DNA, 486 bp, Homo sapiens; identical to SEQ ID NO: 536323
  misc_feature: HIJSMM301CNYFK.10.2.A02.1.454.light.4.raw

SEQ ID NO: 540052 - DNA, 453 bp, Homo sapiens
  misc_feature: HIJSMM301B7OFG.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggccaagctgaccgtcctaagtcagcgcaaggctgccccctcggtcactctgttcccaccctcctccacgagagta

SEQ ID NO: 540053 - DNA, 447 bp, Homo sapiens; identical to SEQ ID NO: 535201
  misc_feature: HIJSMM301BA0ZW.18.9.A09.1.454.light.4.raw

SEQ ID NO: 540054 - DNA, 504 bp, Homo sapiens
  misc_feature: HIJSMM301B9ILW.43.71.G05.1.454.light.4.raw
tgtgagtagtcacgaccggtgctcgatttagtgtcgtcgcaagagagaggggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagaccggaccctgaagattttgcagtgtattactgtcagcagtatggtagctcaccgatcaccttcggccaagggacacgactggagattaaccgaactgtggctgcaccatctgtcttcatcttccccg

SEQ ID NO: 540055 - DNA, 506 bp, Homo sapiens
  misc_feature: HIJSMM301CNAN3.18.11.A11.1.454.light.4.raw
  modified_base (396)..(396): a, c, t, g, unknown or other
  modified_base (439)..(439): a, c, t, g, unknown or other
tacgagtatgcacgaccggtgctcgatttagctacgactgcagggggaggctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccgggtcctgaccgattcagaggcagcgggtctgggacagatttcactctcaccatcaccactgcaggctgaagntgtggctagtttattactgtcagcaatactatacgtcctcctntcctaggttccggcggacgggaaccaggtggagactacaaacgactgtggctgcaccatctgtcttc

SEQ ID NO: 540056 - DNA, 485 bp, Homo sapiens; identical to SEQ ID NO: 535606
  misc_feature: HIJSMM301A89AD.47.46.E02.1.454.light.4.raw

SEQ ID NO: 540057 - DNA, 492 bp, Homo sapiens
  misc_feature: HIJSMM301C1EZ3.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 540058 - DNA, 498 bp, Homo sapiens
  misc_feature: HIJSMM301D3JTE.43.28.C06.1.454.light.4.raw
tgtgagtagtcacgaccggtgctcgatttagagctcacgtattgggtttggggtgactgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaactgtggc

SEQ ID NO: 540059 - DNA, 486 bp, Homo sapiens; identical to SEQ ID NO: 537238
  misc_feature: HIJSMM301AVH6I.19.71.G05.1.454.light.4.raw

SEQ ID NO: 540060 - DNA, 480 bp, Homo sapiens
  misc_feature: HIJSMM301EPFRF.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggttttggctgttcggcggcgggacc

SEQ ID NO: 540061 - DNA, 514 bp, Homo sapiens
  misc_feature: HIJSMM301AWRY3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtactagaccctcccacttcgtcggacgggacgaacggacggacggagtactacgacgaacgtaacgtggtcgtcgtcacccaactaccttcgttcgttcctta

SEQ ID NO: 540062 - DNA, 484 bp, Homo sapiens
  misc_feature: HIJSMM301AOW6S.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccgaaggtggagatcaaacgaa

SEQ ID NO: 540063 - DNA, 444 bp, Homo sapiens; identical to SEQ ID NO: 535027
  misc_feature: HIJSMM301EESPP.8.73.G07.1.454.light.4.raw

SEQ ID NO: 540064 - DNA, 490 bp, Homo sapiens; identical to SEQ ID NO: 538273
  misc_feature: HIJSMM301BH43M.16.73.G07.1.454.light.4.raw

SEQ ID NO: 540065 - DNA, 509 bp, Homo sapiens
  misc_feature: HIJSMM301C2PLG.2.76.G10.1.454.light.4.raw
  modified_base (464)..(464): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaaccgtgggtncttatctcttcggacctgggaccaaggtccaccgttccttggtac

SEQ ID NO: 540066 - DNA, 495 bp, Homo sapiens
  misc_feature: HIJSMM301B3GN7.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgcgtgcgtctagggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccatctgtctt

SEQ ID NO: 540067 - DNA, 449 bp, Homo sapiens
  misc_feature: HIJSMM301C6HW1.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccactactcgta

SEQ ID NO: 540068 - DNA, 488 bp, Homo sapiens
  misc_feature: HIJSMM301EAVGX.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaaa

SEQ ID NO: 540069 - DNA, 460 bp, Homo sapiens
  misc_feature: HIJSMM301AMHUA.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctcg

SEQ ID NO: 540070 - DNA, 447 bp, Homo sapiens; identical to SEQ ID NO: 535020
  misc_feature: HIJSMM301A1GUB.18.9.A09.1.454.light.4.raw

SEQ ID NO: 540071 - DNA, 474 bp, Homo sapiens
  misc_feature: HIJSMM301DCHBT.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctccgctcacttcggcggaggaccaaggtggagatacaaacgaactgtggctgca

SEQ ID NO: 540072 - DNA, 481 bp, Homo sapiens
  misc_feature: HIJSMM301EPLMI.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggcctggaccaagtggatatcaaacgaactgtggctgcaccatctgt

SEQ ID NO: 540073 - DNA, 488 bp, Homo sapiens; identical to SEQ ID NO: 535990
  misc_feature: HIJSMM301ELQ1A.11.28.C06.1.454.light.4.raw

SEQ ID NO: 540074 - DNA, 486 bp, Homo sapiens
  misc_feature: HIJSMM301ADP5Z.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccgaacctggagat

SEQ ID NO: 540075 - DNA, 496 bp, Homo sapiens
  misc_feature: HIJSMM301CAGPG.41.14.B03.1.454.light.4.raw
tctatactatcacgaccggtgctcgatttagtgtgagtagttccgcggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 540076 - DNA, 486 bp, Homo sapiens; identical to SEQ ID NO: 535043
  misc_feature: HIJSMM301EL5KC.46.35.D02.1.454.light.4.raw

SEQ ID NO: 540077 - DNA, 509 bp, Homo sapiens; identical to SEQ ID NO: 539359
  misc_feature: HIJSMM301CY8M7.47.85.H08.1.454.light.4.raw

SEQ ID NO: 540078 - DNA, 496 bp, Homo sapiens
  misc_feature: HIJSMM301CF9GX.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactctttctcttcggaactgggaccacggtcaccgtcctaggtcagcccaaggccaaccccactgcactctgttcccgccctcctccgtatctct

SEQ ID NO: 540079 - DNA, 493 bp, Homo sapiens; identical to SEQ ID NO: 535745
  misc_feature: HIJSMM301BUVJ9.47.78.H01.1.454.light.4.raw

SEQ ID NO: 540080 - DNA, 491 bp, Homo sapiens
  misc_feature: HIJSMM301ALM3R.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtggacgttcggtccaagggaccaaggtggatatcagacgaa

SEQ ID NO: 540081 - DNA, 492 bp, Homo sapiens
  misc_feature: HIJSMM301A415K.5.11.A11.1.454.light.4.raw
atcagacacgcacgaccggtgctcgatttagctacgactgcaggggtgatcaggactcctcagttcaccttctcacaatgaggctccctgctcagctcctggggctgctaatgctctgggtcccaggatccagtggggagtgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaaactgtggctgcacc

SEQ ID NO: 540082 - DNA, 491 bp, Homo sapiens
  misc_feature: HIJSMM301BDBV3.49.61.F06.1.454.light.4.raw
agtcgagagacacgaccggtgctcgatttagctacgctctaagggaagggggaagagctgctcagttaggacccagagggaaccatggaaaccccagcgcagcttctcttcctcctgctactctggctcccagataccaccgcagaaattgtgttgacacagtctccaggcaccctgtctttgtctccaggggaaagagccaccctctcctgcagggccagtcagagcgttagcaacagttatgtagcctggtaccagcagaaacctggccagtctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggccaggggaccaagctggagatcaagcgaactgtggctgcaccatctgtctt

SEQ ID NO: 540083 - DNA, 524 bp, Homo sapiens
  misc_feature: HIJSMM301AYRTJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaaggtacgaaacgaacgtacgtggcgtcggcaccactactgtcttcctactcttcccgtcccact

SEQ ID NO: 540084 - DNA, 485 bp, Homo sapiens
  misc_feature: HIJSMM301DUD5T.47.78.H01.1.454.light.4.raw
  modified_base (467)..(467): a, c, t, g, unknown or other
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccnccctcctctacgtgagct

SEQ ID NO: 540085 - DNA, 421 bp, Homo sapiens
  misc_feature: HIJSMM301EF8IX.41.12.B01.1.454.light.4.raw
tctatactatcacgaccggtgctcgatttagtagtgtagattccgcgggcacgaccggtgctcgatttagtagcatactgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 540086 - DNA, 421 bp, Homo sapiens; identical to SEQ ID NO: 536457
  misc_feature: HIJSMM301AIOMF.9.34.D01.1.454.light.4.raw

SEQ ID NO: 540087 - DNA, 477 bp, Homo sapiens
  misc_feature: HIJSMM301CFKV3.52.73.G07.1.454.light.4.raw
cgcagtacgacacgaccggtgctcgatttagctctacgctcaggggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 540088 - DNA, 444 bp, Homo sapiens; identical to SEQ ID NO: 535192
  misc_feature: HIJSMM301EQL27.5.9.A09.1.454.light.4.raw

SEQ ID NO: 540089 - DNA, 504 bp, Homo sapiens
  misc_feature: HIJSMM301BU1A0.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaagggaccaaggtggaaatcaaacgaactgtggctgcaccat

SEQ ID NO: 540090 - DNA, 486 bp, Homo sapiens
  misc_feature: HIJSMM301DP81A.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacca

SEQ ID NO: 540091 - DNA, 389 bp, Homo sapiens
  misc_feature: HIJSMM301EWA09.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcgacga

SEQ ID NO: 540092 - DNA, 496 bp, Homo sapiens; identical to SEQ ID NO: 535109
  misc_feature: HIJSMM301B1LXS.16.78.H01.1.454.light.4.raw

SEQ ID NO: 540093 - DNA, 447 bp, Homo sapiens; identical to SEQ ID NO: 535201
  misc_feature: HIJSMM301EAWHP.18.9.A09.1.454.light.4.raw

SEQ ID NO: 540094 - DNA, 492 bp, Homo sapiens
  misc_feature: HIJSMM301ETJFJ.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcacgtccg

SEQ ID NO: 540095 - DNA, 494 bp, Homo sapiens; identical to SEQ ID NO: 539784
  misc_feature: HIJSMM301A8X2R.22.57.F02.1.454.light.4.raw

SEQ ID NO: 540096 - DNA, 496 bp, Homo sapiens
  misc_feature: HIJSMM301BSKEL.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggaggatcaaacgaactgtggctgcaccatctgtcttcatcttcccgcc

SEQ ID NO: 540097 - DNA, 488 bp, Homo sapiens; identical to SEQ ID NO: 535081
  misc_feature: HIJSMM301BXXBA.26.23.C01.1.454.light.4.raw

SEQ ID NO: 540098 - DNA, 486 bp, Homo sapiens
  misc_feature: HIJSMM301B2FEU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccgacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggatatcagacgaa

SEQ ID NO: 540099 - DNA, 447 bp, Homo sapiens; identical to SEQ ID NO: 535020
  misc_feature: HIJSMM301CXUID.18.9.A09.1.454.light.4.raw

SEQ ID NO: 540100 - DNA, 490 bp, Homo sapiens; identical to SEQ ID NO: 534991
  misc_feature: HIJSMM301D4XMN.48.75.G09.1.454.light.4.raw

SEQ ID NO: 540101 - DNA, 513 bp, Homo sapiens
  misc_feature: HIJSMM301DX6AQ.15.86.H09.1.454.light.4.raw
  modified_base (400)..(400): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaagacggttgggtgttcggcggagggaccaagctgaccgtctagggtcagcccaaggctgccccctcggtcactctgttcccaccctcctcgctacgtag

SEQ ID NO: 540102 - DNA, 507 bp, Homo sapiens; identical to SEQ ID NO: 535641
  misc_feature: HIJSMM301CVJ1K.10.88.H11.1.454.light.4.raw

SEQ ID NO: 540103 - DNA, 485 bp, Homo sapiens; identical to SEQ ID NO: 536723
  misc_feature: HIJSMM301A5SNP.5.40.D07.1.454.light.4.raw

SEQ ID NO: 540104 - DNA, 494 bp, Homo sapiens; identical to SEQ ID NO: 534992
  misc_feature: HIJSMM301CHH2M.9.1.A01.1.454.light.4.raw

SEQ ID NO: 540105 - DNA, 484 bp, Homo sapiens; identical to SEQ ID NO: 535211
  misc_feature: HIJSMM301CDT3X.47.46.E02.1.454.light.4.raw

SEQ ID NO: 540106 - DNA, 517 bp, Homo sapiens
  misc_feature: HIJSMM301AD911.10.26.C04.1.454.light.4.raw
catagtagtgcacgaccggtgctcgattagtctagcgactttgggtttgggggctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccccgtggacgttcggccaagggaccaaggtggcaatcaaccgaactgtggctgcaccatctgtcttcatcttcccgcca

SEQ ID NO: 540107 - DNA, 512 bp, Homo sapiens
  misc_feature: HIJSMM301A2SOX.13.4.A04.1.454.light.4.raw
tcacgtactacacgaccggtgctcgatttagagtagtgatcagggggcagttggtagatgcccctctgggagagactccccgaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactcgtcactctgtt

SEQ ID NO: 540108 - DNA, 512 bp, Homo sapiens
  misc_feature: HIJSMM301AUB2M.40.12.B01.1.454.light.4.raw
tctagcgactcacgaccggtgctcgatttagtagtgtagattccgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctcg

SEQ ID NO: 540109 - DNA, 474 bp, Homo sapiens
  misc_feature: HIJSMM301BS204.12.49.E05.1.454.light.4.raw
  modified_base (407)..(407): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttnttactgtcaaaagtataacagtgcccccttcaccttcggccaagggacacgactggagattagaacg

SEQ ID NO: 540110 - DNA, 494 bp, Homo sapiens
  misc_feature: HIJSMM301A7IBG.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 540111 - DNA, 510 bp, Homo sapiens
  misc_feature: HIJSMM301CCZH5.2.71.G05.1.454.light.4.raw
acgctcgacacacgaccggtgctcgatttagtgtcgtcgcaagagagaggggggcgtcagaagcagagttctggggtggtctccaccatggcctggacccctcctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctcgccccctcggtcactt

SEQ ID NO: 540112 - DNA, 513 bp, Homo sapiens
  misc_feature: HIJSMM301APB4Q.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcctagtctacg

SEQ ID NO: 540113 - DNA, 485 bp, Homo sapiens
  misc_feature: HIJSMM301AHZFK.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccaaggtggaactcaacgaa

SEQ ID NO: 540114 - DNA, 484 bp, Homo sapiens; identical to SEQ ID NO: 537689
  misc_feature: HIJSMM301EFG8R.19.71.G05.1.454.light.4.raw

SEQ ID NO: 540115 - DNA, 505 bp, Homo sapiens
  misc_feature: HIJSMM301DGWX8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtcaaacgaactgtggctgcaccatcctgtcttcactcctcccg

SEQ ID NO: 540116 - DNA, 500 bp, Homo sapiens
  misc_feature: HIJSMM301DX2FQ.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaaggaccaaggtaggaagtcagacgaactgtggctgcaccatctgtcttcatcttccccg

SEQ ID NO: 540117 - DNA, 485 bp, Homo sapiens; identical to SEQ ID NO: 536040
  misc_feature: HIJSMM301D4XKE.15.1.A01.1.454.light.4.raw

SEQ ID NO: 540118 - DNA, 514 bp, Homo sapiens
  misc_feature: HIJSMM301CLSCO.15.86.H09.1.454.light.4.raw
  modified_base (425)..(425): a, c, t, g, unknown or other
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggngttcggcggagggaccaagctgaccgtcctaggtcagcccaaggctgccccctcggtcactctgttcccaccctcctcgctacgtagac

SEQ ID NO: 540119 - DNA, 441 bp, Homo sapiens; identical to SEQ ID NO: 535074
  misc_feature: HIJSMM301B44XU.11.3.A03.1.454.light.4.raw

SEQ ID NO: 540120 - DNA, 489 bp, Homo sapiens; identical to SEQ ID NO: 535139
  misc_feature: HIJSMM301DHLSH.14.55.E11.1.454.light.4.raw

SEQ ID NO: 540121 - DNA, 483 bp, Homo sapiens
  misc_feature: HIJSMM301BNN14.48.37.D04.1.454.light.4.raw
agtatacatacacgaccggtgctcgatttagtagcatactgttgggtttggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccaatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 540122 - DNA, 502 bp, Homo sapiens
  misc_feature: HIJSMM301AMQH6.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccgccctcc

SEQ ID NO: 540123 - DNA, 464 bp, Homo sapiens; identical to SEQ ID NO: 536640
  misc_feature: HIJSMM301DNAMN.26.78.H01.1.454.light.4.raw

SEQ ID NO: 540124 - DNA, 484 bp, Homo sapiens
  misc_feature: HIJSMM301A6RSW.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcacgtcctaggtcagcccaaggccaaccca

SEQ ID NO: 540125 - DNA, 450 bp, Homo sapiens
  misc_feature: HIJSMM301E28P9.51.46.E02.1.454.light.4.raw
cgatcgtatacacgaccggtgctcgatttagactcatctacagggaaagggagagtggagactgagtcatcacaacagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccatctgtcttcatcttcccgccatctgatcgtagcact

SEQ ID NO: 540126 - DNA, 489 bp, Homo sapiens
  misc_feature: HIJSMM301DJAJH.49.37.D04.1.454.light.4.raw
agtcgagagacacgaccggtgctcgatttagtagcatactgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 540127 - DNA, 493 bp, Homo sapiens
  misc_feature: HIJSMM301ASYCZ.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcatt

SEQ ID NO: 540128 - DNA, 444 bp, Homo sapiens; identical to SEQ ID NO: 535192
  misc_feature: HIJSMM301BZN29.5.9.A09.1.454.light.4.raw

SEQ ID NO: 540129 - DNA, 502 bp, Homo sapiens
  misc_feature: HIJSMM301B9BIN.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtccccactgttgtacttttcggcggagggaccaagcctgaccgtcctaggtcagcccaaggctgccccctcggtcactctgttcccacctcctcgctacgtaga

SEQ ID NO: 540130 - DNA, 499 bp, Homo sapiens
  misc_feature: HIJSMM301ENZT2.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccagggctgacaacacggcctacctgacgatctctgggctccaggctgaggacgaggctgactattattgctgcgcatacacaggaagtagcacatgggtgtgcggcggagggaccaaggtgaccgtcctgggtcagcccaaggctgccccctcggtcactctgttcccaccctcctccacgagagta

SEQ ID NO: 540131 - DNA, 486 bp, Homo sapiens
  misc_feature: HIJSMM301C704R.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccatctgtctt

SEQ ID NO: 540132 - DNA, 496 bp, Homo sapiens
  misc_feature: HIJSMM301BZ5V4.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactccgggccagcagtggtaacattgtgatattcggcggagggaccaaggtgaccgtcctacgtcagcccaaggctgccccctcggtcactctcg

SEQ ID NO: 540133 - DNA, 471 bp, Homo sapiens; identical to SEQ ID NO: 536384
  misc_feature: HIJSMM301CSKXM.18.76.G10.1.454.light.4.raw

SEQ ID NO: 540134 - DNA, 507 bp, Homo sapiens
  misc_feature: HIJSMM301CDP3T.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtggatatcaaacgaactcgtggctgcaccatctgtt

SEQ ID NO: 540135 - DNA, 520 bp, Homo sapiens
  misc_feature: HIJSMM301EDU9K.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtcgtaccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtcgacggacgaacggtaggaaggtacaacgaactacgtggcgtgcgaccaactctggtcttctactccttcccgtcccact

SEQ ID NO: 540136 - DNA, 503 bp, Homo sapiens
  misc_feature: HIJSMM301A02NC.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttccccg

SEQ ID NO: 540137 - DNA, 489 bp, Homo sapiens; identical to SEQ ID NO: 535091
  misc_feature: HIJSMM301ADM90.47.36.D03.1.454.light.4.raw

SEQ ID NO: 540138 - DNA, 494 bp, Homo sapiens; identical to SEQ ID NO: 534992
  misc_feature: HIJSMM301APNT6.9.1.A01.1.454.light.4.raw

SEQ ID NO: 540139 - DNA, 486 bp, Homo sapiens; identical to SEQ ID NO: 537127
  misc_feature: HIJSMM301C837X.3.77.G11.1.454.light.4.raw

SEQ ID NO: 540140 - DNA, 510 bp, Homo sapiens
  misc_feature: HIJSMM301AQUK8.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtgtctgat

SEQ ID NO: 540141 - DNA, 486 bp, Homo sapiens
  misc_feature: HIJSMM301DL1RF.4.27.C05.1.454.light.4.raw
agcactgtagcacgaccggtgctcgatttagacgcgatcgaagggtttggggtgactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggttactactgcatgcaagctctacaagccacctacacttttggccaggggaccaggctggagatcaaacgaa

SEQ ID NO: 540142 - DNA, 509 bp, Homo sapiens
  misc_feature: HIJSMM301B8V5J.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccg

SEQ ID NO: 540143 - DNA, 490 bp, Homo sapiens
  misc_feature: HIJSMM301A2HJ0.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttc

SEQ ID NO: 540144 - DNA, 499 bp, Homo sapiens
  misc_feature: HIJSMM301C5AAM.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaacgaactgtggctgcaccatctgtcttcatcttcccgccat

SEQ ID NO: 540145 - DNA, 486 bp, Homo sapiens
  misc_feature: HIJSMM301BYISK.43.28.C06.1.454.light.4.raw
tgtgagtagtcacgaccggtgctcgatttagagctcacgtattgggtttggggtgatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccagggaccaagctggagatcaaacgaa

SEQ ID NO: 540146 - DNA, 481 bp, Homo sapiens
  misc_feature: HIJSMM301ALTUM.16.86.H09.1.454.light.4.raw
tgtactactccacgaccggtgctcgatttagtgctatagacttgggtttgggggggtcgtcaggaggcagcgctctcaggacatctccaccatggcctgggctctgctgctcctcaccctcctcactcagggcacagggtccgtgggtcctccactggaaccagcagtgacgttggtggttataactttgtctcctgataccaacagcacccaggcaaagcacccaaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctccggtcactctgttcccgccctcctcgagtagtaca

SEQ ID NO: 540147 - DNA, 488 bp, Homo sapiens; identical to SEQ ID NO: 536554
  misc_feature: HIJSMM301DIRGZ.26.37.D04.1.454.light.4.raw

SEQ ID NO: 540148 - DNA, 488 bp, Homo sapiens
  misc_feature: HIJSMM301ELYQU.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggacgtaaggtggaggatcagacggaactgtggctgcaccatctgtcttcta

SEQ ID NO: 540149 - DNA, 478 bp, Homo sapiens
  misc_feature: HIJSMM301C0QXS.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggcctcaggtattcctgagcgattctctggctccagttctgggaacacagccactctgaccatcagcgggacccaggctatggatgaggctgactattaactgtcaggcgtgggacatcagcagtgaggtggttttcggcggagggaccaagctgaccgtcctaagtcagcccaa

SEQ ID NO: 540150 - DNA, 499 bp, Homo sapiens
  misc_feature: HIJSMM301AKBVA.4.64.F09.1.454.light.4.raw
agcactgtagcacgaccggtgctcgatttagcgcgtatacaagggggaggtcagacccacgtcaggacacagcgtggacatgagggtccccgcctcagctcctggggcgtcctgctgctctggttcccacggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaacgaactgtggctgtaccatctgtcttcatcttccccg

SEQ ID NO: 540151 - DNA, 499 bp, Homo sapiens; identical to SEQ ID NO: 538774
  misc_feature: HIJSMM301APOPM.26.26.C04.1.454.light.4.raw

SEQ ID NO: 540152 - DNA, 484 bp, Homo sapiens
  misc_feature: HIJSMM301B9TMA.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaacttttggccagggaccaagctggagatcaaacgaactgtggctgcaccat

SEQ ID NO: 540153 - DNA, 515 bp, Homo sapiens
  misc_feature: HIJSMM301DZOG5.52.87.H10.1.454.light.4.raw
cgcagtacgacacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggtttcggcggagggaccaaggtgaccgtcctacgtcagcccaaggctgccccctcggtcactctgtt

SEQ ID NO: 540154 - DNA, 517 bp, Homo sapiens
  misc_feature: HIJSMM301C2HBD.41.55.E11.1.454.light.4.raw
tctatactatcacgaccggtgctcgatttagcactcgcacgttgggtttggggctgggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccaccct

SEQ ID NO: 540155 - DNA, 484 bp, Homo sapiens
  misc_feature: HIJSMM301B6743.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccagggtggaaatcaaacgaactgtggctgcacca

SEQ ID NO: 540156 - DNA, 504 bp, Homo sapiens; identical to SEQ ID NO: 535128
  misc_feature: HIJSMM301B3CS1.19.85.H08.1.454.light.4.raw

SEQ ID NO: 540157 - DNA, 484 bp, Homo sapiens; identical to SEQ ID NO: 535400
  misc_feature: HIJSMM301BG818.46.26.C04.1.454.light.4.raw

SEQ ID NO: 540158 - DNA, 480 bp, Homo sapiens
  misc_feature: HIJSMM301C6V87.41.17.B06.1.454.light.4.raw
  modified_base (458)..(458): a, c, t, g, unknown or other
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggctaggctcccaggctcctcatctatgctgcatccaccagggccactggtatcccagccaggttcagtggcggtgggtctgggacagagtttactctcaccatcaacggcctgcagtctgaagattctgcagtttattactgtcagcagtatgttgactggcctccgctcactttcggcggagggaccaaggtggagntcagacgaactgtggctgcacc

SEQ ID NO: 540159 - DNA, 490 bp, Homo sapiens
  misc_feature: HIJSMM301CT1D8.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttatactgtcagcaatattctactactcctcggactttcggcggagggaccaaggtggagatacaaacgaactgt

SEQ ID NO: 540160 - DNA, 497 bp, Homo sapiens
  misc_feature: HIJSMM301EJ7C3.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaaacctgtggctgcaccatctgtcttcat

SEQ ID NO: 540161 - DNA, 472 bp, Homo sapiens
  misc_feature: HIJSMM301D2NVV.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttatactgtcaacagagtaacagttaccctcccactttcggccggagggaccaaggtggagatcaaacgaactgtgg

SEQ ID NO: 540162 - DNA, 518 bp, Homo sapiens
  misc_feature: HIJSMM301CHY7V.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcagggtcagcccaaggctgccccctcggtcactctgttcccgccctcctccacg

SEQ ID NO: 540163 - DNA, 503 bp, Homo sapiens
  misc_feature: HIJSMM301BU84F.10.7.A07.1.454.light.4.raw
catagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattaggagctccttagcctggtaccaacagaaatatggccaggctcccaggctcctcatctatgaaacatccaatagggccactgccatccctgccaggttcagtggcagtgggtctgggacagacttcactctcatcatcagcggcctagagcctgaagattctgcagtttactactgtcagcaccgtaccgagtggcctccccaacccactttcggcggagggaccaaggtggagatcaaacgaactgtggctgcaccatctgtcttcatcttccccg

SEQ ID NO: 540164 - DNA, 494 bp, Homo sapiens; identical to SEQ ID NO: 534992
  misc_feature: HIJSMM301AYGOC.9.1.A01.1.454.light.4.raw

SEQ ID NO: 540165 - DNA, 485 bp, Homo sapiens; identical to SEQ ID NO: 539315
  misc_feature: HIJSMM301DCI15.3.88.H11.1.454.light.4.raw

SEQ ID NO: 540166 - DNA, 486 bp, Homo sapiens; identical to SEQ ID NO: 537310
  misc_feature: HIJSMM301DODYT.15.28.C06.1.454.light.4.raw

SEQ ID NO: 540167 - DNA, 486 bp, Homo sapiens; identical to SEQ ID NO: 536323
  misc_feature: HIJSMM301BD4WD.10.2.A02.1.454.light.4.raw

SEQ ID NO: 540168 - DNA, 510 bp, Homo sapiens
  misc_feature: HIJSMM301D1XGT.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcggggaccgaggtcaccgtcctaggtcagcccaaggccaaccccactgtcactctgttcccg

SEQ ID NO: 540169 - DNA, 486 bp, Homo sapiens
  misc_feature: HIJSMM301D0MAB.48.33.C11.1.454.light.4.raw
agtatacatacacgaccggtgctcgatttagagtgagctcgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggcc

SEQ ID NO: 540170 - DNA, 506 bp, Homo sapiens
  misc_feature: HIJSMM301CJ5JM.12.28.C06.1.454.light.4.raw
atacgacgtacacgaccggtgctcgatttagagctcacgtattgggtttggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcacgggacgacacgtagaatagagacgaactagtggcgtgcgccaactctgtcttctactcttcccgt

SEQ ID NO: 540171 - DNA, 518 bp, Homo sapiens
  misc_feature: HIJSMM301CPRA4.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctctcg

SEQ ID NO: 540172 - DNA, 483 bp, Homo sapiens; identical to SEQ ID NO: 535256
  misc_feature: HIJSMM301AUKZ7.47.60.F05.1.454.light.4.raw

SEQ ID NO: 540173 - DNA, 476 bp, Homo sapiens
  misc_feature: HIJSMM301EUWQW.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggtttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 540174 - DNA, 441 bp, Homo sapiens; identical to SEQ ID NO: 535074
  misc_feature: HIJSMM301BDSXS.11.3.A03.1.454.light.4.raw

SEQ ID NO: 540175 - DNA, 472 bp, Homo sapiens
  misc_feature: HIJSMM301CNYR4.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggtccctgggactgaagtgcatatgaagagaactgtgg

SEQ ID NO: 540176 - DNA, 507 bp, Homo sapiens
  misc_feature: HIJSMM301COIVM.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccaacgtggaaatacaaacgaactgtggctgcaccatctgtcttcta

SEQ ID NO: 540177 - DNA, 443 bp, Homo sapiens
  misc_feature: HIJSMM301BREPC.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctggtcactctgttcccaccctcctcgacacgcgag

SEQ ID NO: 540178 - DNA, 488 bp, Homo sapiens
  misc_feature: HIJSMM301B0VVY.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagtggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgtactagacg

SEQ ID NO: 540179 - DNA, 493 bp, Homo sapiens
  misc_feature: HIJSMM301DYKYC.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtgctgcaccatctgtctt

SEQ ID NO: 540180 - DNA, 509 bp, Homo sapiens
  misc_feature: HIJSMM301BME1D.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaaggctgaccgtcctcggtcagcccaaggctgccccctc

SEQ ID NO: 540181 - DNA, 497 bp, Homo sapiens
  misc_feature: HIJSMM301CFTHS.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaacgaactgtggctgcaccatctgtcttcat

SEQ ID NO: 540182 - DNA, 480 bp, Homo sapiens; identical to SEQ ID NO: 535975
  misc_feature: HIJSMM301ENOI0.51.60.F05.1.454.light.4.raw

SEQ ID NO: 540183 - DNA, 514 bp, Homo sapiens; identical to SEQ ID NO: 538541
  misc_feature: HIJSMM301CIDVM.47.23.C01.1.454.light.4.raw

SEQ ID NO: 540184 - DNA, 498 bp, Homo sapiens
  misc_feature: HIJSMM301C2SF3.52.78.H01.1.454.light.4.raw
  modified_base (488)..(488): a, c, t, g, unknown or other
cgcagtacgacacgaccggtgctcgatttagtgtgagtagtttgggtttgggaggcagaactctgggtgtctcaccatggcctggatccctctacttctccccctcctcactctctacacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctggtcactcngttcccacct

SEQ ID NO: 540185 - DNA, 487 bp, Homo sapiens; identical to SEQ ID NO: 535358
  misc_feature: HIJSMM301BBL1G.47.70.G04.1.454.light.4.raw

SEQ ID NO: 540186 - DNA, 494 bp, Homo sapiens; identical to SEQ ID NO: 534994
  misc_feature: HIJSMM301AE4I6.27.78.H01.1.454.light.4.raw

SEQ ID NO: 540187 - DNA, 501 bp, Homo sapiens; identical to SEQ ID NO: 538461
  misc_feature: HIJSMM301AMHVB.13.11.A11.1.454.light.4.raw

SEQ ID NO: 540188 - DNA, 453 bp, Homo sapiens
  misc_feature: HIJSMM301AMVVJ.19.86.H09.1.454.light.4.raw
  modified_base (435)..(435): a, c, t, g, unknown or other
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccnccctcctccacgagagta

SEQ ID NO: 540189 - DNA, 509 bp, Homo sapiens
  misc_feature: HIJSMM301CG6KD.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggtccaacgggaccgaacggtggaaagtacaaacgaactagtggcgtgcgaccatctgtcttcctatcttccccg

SEQ ID NO: 540190 - DNA, 481 bp, Homo sapiens
  misc_feature: HIJSMM301DL1FN.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggaggatcaaacgaaactgtggctgca

SEQ ID NO: 540191 - DNA, 520 bp, Homo sapiens
  misc_feature: HIJSMM301C5YM1.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctcccggtccgaggatgaggctgattattactgtgcagcatgggatgacagcctgagtggtccgttgggtggttcggcggagggaccgaagctgaccgtcctaagtcagcccaaggctgccccctccggtcactctgttcccaccctcctcg

SEQ ID NO: 540192 - DNA, 485 bp, Homo sapiens
  misc_feature: HIJSMM301CXQ1M.46.26.C04.1.454.light.4.raw
actagcagtacacgaccggtgctcgatttagtctagcgactttggggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 540193 - DNA, 482 bp, Homo sapiens; identical to SEQ ID NO: 535352
  misc_feature: HIJSMM301CVHGE.16.81.H04.1.454.light.4.raw

SEQ ID NO: 540194 - DNA, 496 bp, Homo sapiens; identical to SEQ ID NO: 535109
  misc_feature: HIJSMM301DIU0E.16.78.H01.1.454.light.4.raw

SEQ ID NO: 540195 - DNA, 483 bp, Homo sapiens; identical to SEQ ID NO: 536836
  misc_feature: HIJSMM301BPV33.3.38.D05.1.454.light.4.raw

SEQ ID NO: 540196 - DNA, 502 bp, Homo sapiens
  misc_feature: HIJSMM301C68RH.40.45.E01.1.454.light.4.raw
tctagcgactcacgaccggtgctcgatttagtgagtcagtaagggaaagggggaggaactgctcagttaggacccagagggaaccatggaagccccagctcagcttctcttcctcctgctactctggctcccagtaatcaccggagaaattgtgttgacacagtctccagccaccctgtccttctctccaggggaaagagcctccctctcctgcagggccagtcagagtattaataccttcttggcctggtaccagcaaaagcctggccaggctcccagactcctcatctatgatgcatccaacagggccactggcgtcccggccaggttcagtggcagtgggtctgggacagacttcactctcaccatcagcagcctagagcctgaagattttgcagtttattactgtcagcagcgtgccaactggcctctcactttcggcggagggaccaaggtggagatcaaacgaactgtggctgcaccatctgtcttcatcttcccg

SEQ ID NO: 540197 - DNA, 492 bp, Homo sapiens; identical to SEQ ID NO: 539630
  misc_feature: HIJSMM301BQ17M.22.25.C03.1.454.light.4.raw

SEQ ID NO: 540198 - DNA, 334 bp, Homo sapiens
  misc_feature: HIJSMM301COVIC.11.67.G01.1.454.light.4.raw
cgagagataccacgaccggtgctcgatttagagtatacatattgggtttgggaacctatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctgttcccaccctcctcgtatctctcg

SEQ ID NO: 540199 - DNA, 486 bp, Homo sapiens
  misc_feature: HIJSMM301BZO63.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggagtatcagacgaa

SEQ ID NO: 540200 - DNA, 383 bp, Homo sapiens; identical to SEQ ID NO: 447524
  misc_feature: HIJSMM301BSINP.41.26.C04.1.454.light.4.raw

SEQ ID NO: 540201 - DNA, 497 bp, Homo sapiens
  misc_feature: HIJSMM301B0KO2.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaaacaaaagcctggccaggctcccagactcctcatctctggtgcatcttcgagggccactggtgtcccagccaggttcagtggcagtgggtctggaacagagttcactctcaccatcagcggcctgcagtctgaagtattttgctagtttattactgtcagcagtataatgacttgggttttattctactttcggccctgggaccaaagtggatttcagacgaactgtggctgcaccatctgtcttcta

SEQ ID NO: 540202 - DNA, 510 bp, Homo sapiens
  misc_feature: HIJSMM301BUOZQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacggctccgacaacaagaactacttagcttggtatcagcaagaaaccaggacagcctcctaaactgctcattaactgggcatctacccggcaagtcccggggtccctgaccgattcagtggcagcgggtctgggacagatttcactctcaccatcagcagcctgcaggctgaagatggtggctagtttattactgtcaactagttttctcgggcgttcgccgaaggaccaaggtaggaaatcaaacgaactagtggctgcaccatctgtcttcatcttccccg

SEQ ID NO: 540203 - DNA, 492 bp, Homo sapiens; identical to SEQ ID NO: 535126
  misc_feature: HIJSMM301BM4NA.18.11.A11.1.454.light.4.raw

SEQ ID NO: 540204 - DNA, 490 bp, Homo sapiens
  misc_feature: HIJSMM301BX6WS.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcggccagggaccacagtggatatcaggcgaactgtggctgcaccatctgtctt

SEQ ID NO: 540205 - DNA, 506 bp, Homo sapiens; identical to SEQ ID NO: 534969
  misc_feature: HIJSMM301AMJEK.18.37.D04.1.454.light.4.raw

SEQ ID NO: 540206 - DNA, 474 bp, Homo sapiens; identical to SEQ ID NO: 538292
  misc_feature: HIJSMM301EBZCV.52.1.A01.1.454.light.4.raw

SEQ ID NO: 540207 - DNA, 496 bp, Homo sapiens
  misc_feature: HIJSMM301DS9QX.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaac

SEQ ID NO: 540208 - DNA, 450 bp, Homo sapiens
  misc_feature: HIJSMM301EV1CR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactacctcatctttggtagcaacaatcggccctccaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 540209 - DNA, 447 bp, Homo sapiens; identical to SEQ ID NO: 535020
  misc_feature: HIJSMM301DC4AQ.18.9.A09.1.454.light.4.raw

SEQ ID NO: 540210 - DNA, 496 bp, Homo sapiens; identical to SEQ ID NO: 535109
  misc_feature: HIJSMM301AE25Y.16.78.H01.1.454.light.4.raw

SEQ ID NO: 540211 - DNA, 481 bp, Homo sapiens
  misc_feature: HIJSMM301AJNA2.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcaccat

SEQ ID NO: 540212 - DNA, 488 bp, Homo sapiens
  misc_feature: HIJSMM301APRZQ.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacacttttggccaggggaccaaactggacatcaaacgaactagtggctgcaccatctgtt

SEQ ID NO: 540213 - DNA, 496 bp, Homo sapiens; identical to SEQ ID NO: 537925
  misc_feature: HIJSMM301DYIX4.22.14.B03.1.454.light.4.raw

SEQ ID NO: 540214 - DNA, 496 bp, Homo sapiens; identical to SEQ ID NO: 535423
  misc_feature: HIJSMM301BKD4L.3.33.C11.1.454.light.4.raw

SEQ ID NO: 540215 - DNA, 507 bp, Homo sapiens
  misc_feature: HIJSMM301BG3MS.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttccc

SEQ ID NO: 540216 - DNA, 445 bp, Homo sapiens
  misc_feature: HIJSMM301DD0GY.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgtctagtacgtga

SEQ ID NO: 540217 - DNA, 497 bp, Homo sapiens; identical to SEQ ID NO: 535286
  misc_feature: HIJSMM301DJ36K.18.59.F04.1.454.light.4.raw

SEQ ID NO: 540218 - DNA, 499 bp, Homo sapiens; identical to SEQ ID NO: 536875
  misc_feature: HIJSMM301COQSG.51.26.C04.1.454.light.4.raw

SEQ ID NO: 540219 - DNA, 500 bp, Homo sapiens
  misc_feature: HIJSMM301B8I8F.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 540220 - DNA, 522 bp, Homo sapiens
  misc_feature: HIJSMM301AW7D7.9.38.D05.1.454.light.4.raw
tgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaatacccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctcacg

SEQ ID NO: 540221 - DNA, 513 bp, Homo sapiens; identical to SEQ ID NO: 535719
  misc_feature: HIJSMM301BEB3G.17.33.C11.1.454.light.4.raw

SEQ ID NO: 540222 - DNA, 447 bp, Homo sapiens; identical to SEQ ID NO: 535201
  misc_feature: HIJSMM301CQB7X.18.9.A09.1.454.light.4.raw

SEQ ID NO: 540223 - DNA, 504 bp, Homo sapiens
  misc_feature: HIJSMM301D8MGZ.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgacgtcctaagtcagcccaaggctgccccctcggtcactctgttcccaccct

SEQ ID NO: 540224 - DNA, 384 bp, Homo sapiens
  misc_feature: HIJSMM301EHOBA.48.53.E09.1.454.light.4.raw
agtatacatacacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 540225 - DNA, 494 bp, Homo sapiens
  misc_feature: HIJSMM301CF17R.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtgggacaaggtcaccgtccaaggtcacg

SEQ ID NO: 540226 - DNA, 522 bp, Homo sapiens
  misc_feature: HIJSMM301BIA8R.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccgccct

SEQ ID NO: 540227 - DNA, 484 bp, Homo sapiens
  misc_feature: HIJSMM301DYDYA.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctcgccccctcggtcactctgttccccaccctcctccgtcgtctcgat

SEQ ID NO: 540228 - DNA, 501 bp, Homo sapiens; identical to SEQ ID NO: 535746
  misc_feature: HIJSMM301BQTMO.18.11.A11.1.454.light.4.raw

SEQ ID NO: 540229 - DNA, 485 bp, Homo sapiens
  misc_feature: HIJSMM301BANAC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgcggaggaccgaagcggagatcagacgaactgtggctgcaccatctgtcttcta

SEQ ID NO: 540230 - DNA, 484 bp, Homo sapiens; identical to SEQ ID NO: 535240
  misc_feature: HIJSMM301A07I2.47.60.F05.1.454.light.4.raw

SEQ ID NO: 540231 - DNA, 489 bp, Homo sapiens; identical to SEQ ID NO: 535139
  misc_feature: HIJSMM301BD2UK.14.55.E11.1.454.light.4.raw

SEQ ID NO: 540232 - DNA, 480 bp, Homo sapiens
  misc_feature: HIJSMM301EERZK.21.14.B03.1.454.light.4.raw
tcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaccccgtacactttaggccaggggaccaagctggagatcaaacgaactgtggctgcacca

SEQ ID NO: 540233 - DNA, 488 bp, Homo sapiens
  misc_feature: HIJSMM301AEJ5B.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattattacttcgtggacgttcggccaagggaccaaggtggatatcagacgaa

SEQ ID NO: 540234 - DNA, 490 bp, Homo sapiens
  misc_feature: HIJSMM301AD6FV.52.83.H06.1.454.light.4.raw
cgcagtacgacacgaccggtgctcgatttagatcacgtgcgtcgcggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttctaccatcagcggcctgcagcctgaagatattgcaacatattactgtcaacagtatggtaatctcccactcactttcggtcggagggaccaaggtcgagatcaaacgaaacctgtggctgcaccatctgtctt

SEQ ID NO: 540235 - DNA, 499 bp, Homo sapiens
  misc_feature: HIJSMM301AF9UE.8.2.A02.1.454.light.4.raw
ctcgcgtgtccacgaccggtgctcgatttagactcatctacagggggaggaactgctcagttaggacccacgagggaaccatggaagccccacgctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaagtggaatcaacgaactgtggctgcaccatctgtcttcatcttcccgtccat

SEQ ID NO: 540236 - DNA, 415 bp, Homo sapiens; identical to SEQ ID NO: 536118
  misc_feature: HIJSMM301BZKLC.18.78.H01.1.454.light.4.raw

SEQ ID NO: 540237 - DNA, 487 bp, Homo sapiens
  misc_feature: HIJSMM301CXNTK.47.67.G01.1.454.light.4.raw
agctcacgtacacgaccggtgctcgatttagagtatacatattgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 540238 - DNA, 483 bp, Homo sapiens
  misc_feature: HIJSMM301DDS7Q.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagattttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 540239 - DNA, 348 bp, Homo sapiens
  misc_feature: HIJSMM301BJAZC.51.68.G02.1.454.light.4.raw
cgatcgtatacacgaccggtgctcgatttagtcgatagtgaagggaaagggtatgatgtacactggtaccagcagcttccaggaacagcccccaaactcctcatttattctaacacccatcggccctcaggggtccctgatcgattctctggctccaagtctggcacctcagcctccctggccatcactggactccaggctgaggatgaggctgattattactgccagtcctatgacatcagcctgagtggttcgtgggtattcggcggagggaccagactgaccgtcctaagtcagcccaaggctgccccctcggtcactctgttcccgccctcctctcgtagcact

SEQ ID NO: 540240 - DNA, 498 bp, Homo sapiens
  misc_feature: HIJSMM301AIKUO.11.21.B10.1.454.light.4.raw
cgagagataccacgaccggtgctcgatttagtgtcgtcgcaagagaggagggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 540241 - DNA, 486 bp, Homo sapiens
  misc_feature: HIJSMM301CEJO1.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgtaac

SEQ ID NO: 540242 - DNA, 463 bp, Homo sapiens; identical to SEQ ID NO: 535062
  misc_feature: HIJSMM301CDTLY.11.73.G07.1.454.light.4.raw

SEQ ID NO: 540243 - DNA, 494 bp, Homo sapiens; identical to SEQ ID NO: 534992
  misc_feature: HIJSMM301C7R9R.9.1.A01.1.454.light.4.raw

SEQ ID NO: 540244 - DNA, 448 bp, Homo sapiens
  misc_feature: HIJSMM301DMAYC.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaacccctctgtcactctgttcccaccctcctccatactcgta

SEQ ID NO: 540245 - DNA, 496 bp, Homo sapiens; identical to SEQ ID NO: 535109
  misc_feature: HIJSMM301EW4U0.16.78.H01.1.454.light.4.raw

SEQ ID NO: 540246 - DNA, 525 bp, Homo sapiens
  misc_feature: HIJSMM301CIR8T.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacctgtcactctcgttcccgccctccctccgtcgt

SEQ ID NO: 540247 - DNA, 489 bp, Homo sapiens
  misc_feature: HIJSMM301BQPUB.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaagaactgtggctgcacca

SEQ ID NO: 540248 - DNA, 490 bp, Homo sapiens; identical to SEQ ID NO: 539515
  misc_feature: HIJSMM301AOWSJ.16.68.G02.1.454.light.4.raw

SEQ ID NO: 540249 - DNA, 495 bp, Homo sapiens
  misc_feature: HIJSMM301BLEWK.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtacaaacgaaacctagtggctgcacca

SEQ ID NO: 540250 - DNA, 486 bp, Homo sapiens; identical to SEQ ID NO: 535043
  misc_feature: HIJSMM301EMTWV.46.35.D02.1.454.light.4.raw

SEQ ID NO: 540251 - DNA, 489 bp, Homo sapiens; identical to SEQ ID NO: 535139
  misc_feature: HIJSMM301ENPSK.14.55.E11.1.454.light.4.raw

SEQ ID NO: 540252 - DNA, 484 bp, Homo sapiens
  misc_feature: HIJSMM301BORM2.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcgccctggaccaaagtggatatcaaacgaactgtggctgcaccatctgtt

SEQ ID NO: 540253 - DNA, 444 bp, Homo sapiens; identical to SEQ ID NO: 535192
  misc_feature: HIJSMM301B7LNL.5.9.A09.1.454.light.4.raw

SEQ ID NO: 540254 - DNA, 469 bp, Homo sapiens
  misc_feature: HIJSMM301BYIVB.49.20.B09.1.454.light.4.raw
agtcgagagacacgaccggtgctcgatttagtgtagtgtgaagggagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgcctcccgctcactttcggcgggggaccgaaggtggagatcaagcgaactgtggctgcacc

SEQ ID NO: 540255 - DNA, 441 bp, Homo sapiens; identical to SEQ ID NO: 534971
  misc_feature: HIJSMM301B8O8P.11.3.A03.1.454.light.4.raw

SEQ ID NO: 540256 - DNA, 491 bp, Homo sapiens
  misc_feature: HIJSMM301CPEK5.46.67.G01.1.454.light.4.raw
actagcagtacacgaccggtgctcgatttagagtatacatattgggtttggggagtctcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggcccctaagctcctaatctatgctgcatccagtttgcaaagtggggtcccatcgaggttcagtggcagtggatctgggacagatttcactctcaccatcagtaatctgcaacgtgaagattttgcaacttattactgtcaacagaattacaatgttttcggccaagggacacgactacaaattaaacgaactgtggctgcaccatctgtcttcatcttcccgccat

SEQ ID NO: 540257 - DNA, 496 bp, Homo sapiens
  misc_feature: HIJSMM301EFJ5E.41.6.A06.1.454.light.4.raw
tctatactatcacgaccggtgctcgatttagatctactgacagggggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgcc

SEQ ID NO: 540258 - DNA, 503 bp, Homo sapiens; identical to SEQ ID NO: 535140
  misc_feature: HIJSMM301BRAQE.18.37.D04.1.454.light.4.raw

SEQ ID NO: 540259 - DNA, 506 bp, Homo sapiens
  misc_feature: HIJSMM301BCQVB.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgctacgtaga

SEQ ID NO: 540260 - DNA, 441 bp, Homo sapiens; identical to SEQ ID NO: 534971
  misc_feature: HIJSMM301B9WBU.11.3.A03.1.454.light.4.raw

SEQ ID NO: 540261 - DNA, 496 bp, Homo sapiens
  misc_feature: HIJSMM301DX9K2.3.78.H01.1.454.light.4.raw
agacgcactccacgaccggtgctcgatttagtgtgagtagtttgggtttgggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcta

SEQ ID NO: 540262 - DNA, 479 bp, Homo sapiens
  misc_feature: HIJSMM301DP3Z3.11.11.A11.1.454.light.4.raw
cgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtttcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtcttca

SEQ ID NO: 540263 - DNA, 490 bp, Homo sapiens; identical to SEQ ID NO: 535234
  misc_feature: HIJSMM301EUZZ9.17.21.B10.1.454.light.4.raw

SEQ ID NO: 540264 - DNA, 491 bp, Homo sapiens
  misc_feature: HIJSMM301BTNUR.48.25.C03.1.454.light.4.raw
agtatacatacacgaccggtgctcgatttagtagtgtagatttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccgaaggtggagatcaaacgaactgtggctgcacc

SEQ ID NO: 540265 - DNA, 519 bp, Homo sapiens
  misc_feature: HIJSMM301CNQNG.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgcg

SEQ ID NO: 540266 - DNA, 501 bp, Homo sapiens
  misc_feature: HIJSMM301A0O3C.41.16.B05.1.454.light.4.raw
tctatactatcacgaccggtgctcgatttagagctcacgtaagggcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgctagtttattactgtcaccaatataataactggtacacttttggccaggggaccaagctcgagatcaaacgaactgt

SEQ ID NO: 540267 - DNA, 486 bp, Homo sapiens; identical to SEQ ID NO: 535043
  misc_feature: HIJSMM301AGN0A.46.35.D02.1.454.light.4.raw

SEQ ID NO: 540268 - DNA, 505 bp, Homo sapiens
  misc_feature: HIJSMM301A8CDT.43.10.A10.1.454.light.4.raw
tgtgagtagtcacgaccggtgctcgatttagcgtcgatctcagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcaaatactattatgccagctggtaccagcagaaaccaagacaggcccctatacttgtcatctatggtaaaaacaaccgaccctcagggatcccagaccgattctctggctccagctcaggcaacacagcttccttgaccatcactggggctcaggcggaagatgaggctgactattactgtaactcccgggacagcaatggtgacctatatgtcttcggaactgggaccaaaggtcaccgtcctaggtcagccccaaggccaacccccacctgtcacctctcgttcccta

SEQ ID NO: 540269 - DNA, 489 bp, Homo sapiens; identical to SEQ ID NO: 536663
  misc_feature: HIJSMM301AU3E1.16.72.G06.1.454.light.4.raw

SEQ ID NO: 540270 - DNA, 502 bp, Homo sapiens
  misc_feature: HIJSMM301CU98M.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacg

SEQ ID NO: 540271 - DNA, 498 bp, Homo sapiens
  misc_feature: HIJSMM301BDCFM.48.37.D04.1.454.light.4.raw
agtatacatacacgaccggtgctcgatttagtagcatactgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 540272 - DNA, 492 bp, Homo sapiens
  misc_feature: HIJSMM301CPCVC.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaaggctgccccctc

SEQ ID NO: 540273 - DNA, 492 bp, Homo sapiens
  misc_feature: HIJSMM301ANWLN.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaacgaactgtgg

SEQ ID NO: 540274 - DNA, 501 bp, Homo sapiens
  misc_feature: HIJSMM301C788M.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggtccaagggaccgagggtggaaagtacaaacgaactagtggctgcaccactctgtcttcatt

SEQ ID NO: 540275 - DNA, 507 bp, Homo sapiens
  misc_feature: HIJSMM301A0B0J.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagactttctacctccaggacacaaaatacagcctctctgaccattactggtctccagcctgacgacgaggctgactactactgctcagcctgggacaccagcctcgctgcttggcttttcggtcggagggaccaagctgaccgtcctgggtcagcccaaggctgccccctccggtcta

SEQ ID NO: 540276 - DNA, 348 bp, Homo sapiens
  misc_feature: HIJSMM301BE141.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 540277 - DNA, 484 bp, Homo sapiens
  misc_feature: HIJSMM301BY2CP.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaaggaccgaagtgggatatcagacgaa

SEQ ID NO: 540278 - DNA, 476 bp, Homo sapiens; identical to SEQ ID NO: 538611
  misc_feature: HIJSMM301B4NGI.7.81.H04.1.454.light.4.raw

SEQ ID NO: 540279 - DNA, 486 bp, Homo sapiens
  misc_feature: HIJSMM301A8OV0.3.55.E11.1.454.light.4.raw
agacgcactccacgaccggtgctcgatttagcactcgcacgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaaggtagaaatacaaacgaactgtggctgcaccatct

SEQ ID NO: 540280 - DNA, 484 bp, Homo sapiens; identical to SEQ ID NO: 535400
  misc_feature: HIJSMM301BFYHD.46.26.C04.1.454.light.4.raw

SEQ ID NO: 540281 - DNA, 491 bp, Homo sapiens
  misc_feature: HIJSMM301CNJXA.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 540282 - DNA, 506 bp, Homo sapiens; identical to SEQ ID NO: 535404
  misc_feature: HIJSMM301CDMT5.10.88.H11.1.454.light.4.raw

SEQ ID NO: 540283 - DNA, 488 bp, Homo sapiens; identical to SEQ ID NO: 539612
  misc_feature: HIJSMM301D5GM1.3.55.E11.1.454.light.4.raw

SEQ ID NO: 540284 - DNA, 447 bp, Homo sapiens; identical to SEQ ID NO: 535201
  misc_feature: HIJSMM301BQWMY.18.9.A09.1.454.light.4.raw

SEQ ID NO: 540285 - DNA, 485 bp, Homo sapiens
  misc_feature: HIJSMM301DHJ2T.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaaggtggagatcaaacgaa

SEQ ID NO: 540286 - DNA, 485 bp, Homo sapiens
  misc_feature: HIJSMM301AKUXY.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 540287 - DNA, 496 bp, Homo sapiens
  misc_feature: HIJSMM301C8ND1.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 540288 - DNA, 503 bp, Homo sapiens; identical to SEQ ID NO: 537189
  misc_feature: HIJSMM301EJ92A.19.85.H08.1.454.light.4.raw

SEQ ID NO: 540289 - DNA, 511 bp, Homo sapiens
  misc_feature: HIJSMM301BBULD.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgccactc

SEQ ID NO: 540290 - DNA, 496 bp, Homo sapiens; identical to SEQ ID NO: 535109
  misc_feature: HIJSMM301DQO00.16.78.H01.1.454.light.4.raw

SEQ ID NO: 540291 - DNA, 495 bp, Homo sapiens; identical to SEQ ID NO: 538651
  misc_feature: HIJSMM301DFKF8.10.79.H02.1.454.light.4.raw

SEQ ID NO: 540292 - DNA, 447 bp, Homo sapiens; identical to SEQ ID NO: 535201
  misc_feature: HIJSMM301EL7ZI.18.9.A09.1.454.light.4.raw

SEQ ID NO: 540293 - DNA, 520 bp, Homo sapiens
  misc_feature: HIJSMM301DYVAZ.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 540294 - DNA, 514 bp, Homo sapiens; identical to SEQ ID NO: 538153
  misc_feature: HIJSMM301D4BQG.17.37.D04.1.454.light.4.raw

SEQ ID NO: 540295 - DNA, 488 bp, Homo sapiens
  misc_feature: HIJSMM301CCC9A.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctacagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaaacgaactgtggctgcaccatctgt

SEQ ID NO: 540296 - DNA, 522 bp, Homo sapiens
  misc_feature: HIJSMM301C2VQM.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcg

SEQ ID NO: 540297 - DNA, 507 bp, Homo sapiens
  misc_feature: HIJSMM301DTF26.48.87.H10.1.454.light.4.raw
agtatacatacacgaccggtgctcgatttagcagtactgcgttgggtttgggcttgatgccttggggtgggaggagagacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccctcctctatgtatact

SEQ ID NO: 540298 - DNA, 503 bp, Homo sapiens
  misc_feature: HIJSMM301DVSMU.18.78.H01.1.454.light.4.raw
tacgagtatgcacgaccggtgctcgatttagtgtgagtagtttgggtttgggggggtctcaggaggcagcactctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaacccactgtca

SEQ ID NO: 540299 - DNA, 505 bp, Homo sapiens; identical to SEQ ID NO: 536254
  misc_feature: HIJSMM301BH96M.7.71.G05.1.454.light.4.raw

SEQ ID NO: 540300 - DNA, 486 bp, Homo sapiens
  misc_feature: HIJSMM301BFUNW.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaacgaactgtggctgcaccatctgt

SEQ ID NO: 540301 - DNA, 510 bp, Homo sapiens
  misc_feature: HIJSMM301ASS8Z.16.1.A01.1.454.light.4.raw
tgtactactccacgaccggtgctcgatttagacgtctcatcaggggggggtctcaggaggcagcgctctcaggacatctccaccatgacctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggtcggaggaccaagctgaccgtcctaggtcagcccaaggctgccccctccggtcactctgtt

SEQ ID NO: 540302 - DNA, 502 bp, Homo sapiens; identical to SEQ ID NO: 537339
  misc_feature: HIJSMM301CUTNL.19.85.H08.1.454.light.4.raw

SEQ ID NO: 540303 - DNA, 509 bp, Homo sapiens
  misc_feature: HIJSMM301CB8H0.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcca

SEQ ID NO: 540304 - DNA, 486 bp, Homo sapiens
  misc_feature: HIJSMM301A3BV0.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaatgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatccagacgaa

SEQ ID NO: 540305 - DNA, 482 bp, Homo sapiens
  misc_feature: HIJSMM301CF7MY.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagtatttcactctcaccatcagcagcctgcagcctgaggatttgcaacttattactgtctacaagattacacttaccctggacgttcggccaagggaccaaggtggaaatacaaacgaactagtggcgtgcacca

SEQ ID NO: 540306 - DNA, 494 bp, Homo sapiens; identical to SEQ ID NO: 534994
  misc_feature: HIJSMM301CI0ND.27.78.H01.1.454.light.4.raw

SEQ ID NO: 540307 - DNA, 494 bp, Homo sapiens
  misc_feature: HIJSMM301DGMIC.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgttcagcagtatagtaactggcctccgtacacttttggccaggggaccaagctagaaatcaaacgaactgtggctgcaccatctgtcttca

SEQ ID NO: 540308 - DNA, 483 bp, Homo sapiens
  misc_feature: HIJSMM301ERKYI.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaaggaccgaaggtggaaagtacaaacgaactagtggctgcacca

SEQ ID NO: 540309 - DNA, 505 bp, Homo sapiens
  misc_feature: HIJSMM301B6LRS.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccgccctcctccgtgt

SEQ ID NO: 540310 - DNA, 463 bp, Homo sapiens; identical to SEQ ID NO: 535062
  misc_feature: HIJSMM301AS2PC.11.73.G07.1.454.light.4.raw

SEQ ID NO: 540311 - DNA, 477 bp, Homo sapiens
  misc_feature: HIJSMM301CTFKM.8.73.G07.1.454.light.4.raw
  modified_base (439)..(439): a, c, t, g, unknown or other
  modified_base (446)..(446): a, c, t, g, unknown or other
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgaacncgacgcncgtagcggcggcgtcggacgacggcgacagt

SEQ ID NO: 540312 - DNA, 508 bp, Homo sapiens
  misc_feature: HIJSMM301A3772.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggtatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtaggaaagtacaaacgaactagtggctgcaccatctgtcttcatcttcccg

SEQ ID NO: 540313 - DNA, 510 bp, Homo sapiens
  misc_feature: HIJSMM301BVBQX.48.11.A11.1.454.light.4.raw
agtatacatacacgaccggtgctcgatttagctacgactgcaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcct

SEQ ID NO: 540314 - DNA, 486 bp, Homo sapiens
  misc_feature: HIJSMM301C9453.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaa

SEQ ID NO: 540315 - DNA, 487 bp, Homo sapiens
  misc_feature: HIJSMM301BHZO0.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaatcaaacgaactgtggctgcaccat

SEQ ID NO: 540316 - DNA, 507 bp, Homo sapiens
  misc_feature: HIJSMM301AZDWH.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctacatatgcaggtcgtatctcttatgttctcggaactgggaccaaggtccaccgtcctaggtcagcccaaggcccaaccccactgtcta

SEQ ID NO: 540317 - DNA, 503 bp, Homo sapiens
  misc_feature: HIJSMM301CF2WU.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccatgtcta

SEQ ID NO: 540318 - DNA, 488 bp, Homo sapiens
  misc_feature: HIJSMM301BOT17.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaacgaactgtggctgcaccatctgtcttaa

SEQ ID NO: 540319 - DNA, 527 bp, Homo sapiens
  misc_feature: HIJSMM301AX32Q.17.31.C09.1.454.light.4.raw
cgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctaaccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacgc

SEQ ID NO: 540320 - DNA, 492 bp, Homo sapiens
  misc_feature: HIJSMM301CN0Z6.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcctcagacgttca

SEQ ID NO: 540321 - DNA, 500 bp, Homo sapiens
  misc_feature: HIJSMM301BLZ74.49.69.G03.1.454.light.4.raw
agtcgagagacacgaccggtgctcgatttagtcgctgcgtaaaggagaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttccg

SEQ ID NO: 540322 - DNA, 506 bp, Homo sapiens
  misc_feature: HIJSMM301CARGC.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactgtggctgcaccatctgtt

SEQ ID NO: 540323 - DNA, 489 bp, Homo sapiens
  misc_feature: HIJSMM301CY9SH.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgactgtgg

SEQ ID NO: 540324 - DNA, 489 bp, Homo sapiens; identical to SEQ ID NO: 535250
  misc_feature: HIJSMM301BT9OZ.14.55.E11.1.454.light.4.raw

SEQ ID NO: 540325 - DNA, 496 bp, Homo sapiens
  misc_feature: HIJSMM301C55OH.40.57.F02.1.454.light.4.raw
tctagcgactcacgaccggtgctcgatttagctcgatatagttgggtttgggggggctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 540326 - DNA, 486 bp, Homo sapiens
  misc_feature: HIJSMM301EWHRH.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccgaaggtggaggatacaaacgaaactagtggctgcacc

SEQ ID NO: 540327 - DNA, 505 bp, Homo sapiens; identical to SEQ ID NO: 535503
  misc_feature: HIJSMM301EQVAU.8.28.C06.1.454.light.4.raw

SEQ ID NO: 540328 - DNA, 489 bp, Homo sapiens; identical to SEQ ID NO: 535139
  misc_feature: HIJSMM301CQZFO.14.55.E11.1.454.light.4.raw

SEQ ID NO: 540329 - DNA, 473 bp, Homo sapiens; identical to SEQ ID NO: 536937
  misc_feature: HIJSMM301DBX9C.13.76.G10.1.454.light.4.raw

SEQ ID NO: 540330 - DNA, 489 bp, Homo sapiens; identical to SEQ ID NO: 535091
  misc_feature: HIJSMM301AG14F.47.36.D03.1.454.light.4.raw

SEQ ID NO: 540331 - DNA, 491 bp, Homo sapiens; identical to SEQ ID NO: 535294
  misc_feature: HIJSMM301C6OF6.16.68.G02.1.454.light.4.raw

SEQ ID NO: 540332 - DNA, 486 bp, Homo sapiens; identical to SEQ ID NO: 536323
  misc_feature: HIJSMM301DFHT5.10.2.A02.1.454.light.4.raw

SEQ ID NO: 540333 - DNA, 491 bp, Homo sapiens
  misc_feature: HIJSMM301ECEJV.51.45.E01.1.454.light.4.raw
cgatcgtatacacgaccggtgctcgatttagtgagtcagtaagggaaaggggatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcacc

SEQ ID NO: 540334 - DNA, 486 bp, Homo sapiens; identical to SEQ ID NO: 535043
  misc_feature: HIJSMM301BXJIN.46.35.D02.1.454.light.4.raw

SEQ ID NO: 540335 - DNA, 446 bp, Homo sapiens
  misc_feature: HIJSMM301A72B2.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaat

SEQ ID NO: 540336 - DNA, 454 bp, Homo sapiens; identical to SEQ ID NO: 536347
  misc_feature: HIJSMM301CTMPL.19.86.H09.1.454.light.4.raw

SEQ ID NO: 540337 - DNA, 506 bp, Homo sapiens
  misc_feature: HIJSMM301A2YDC.48.73.G07.1.454.light.4.raw
agtatacatacacgaccggtgctcgatttagctctacgctcagggcacgaccggtgctcgatttagagctcacgtattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaa

SEQ ID NO: 540338 - DNA, 486 bp, Homo sapiens; identical to SEQ ID NO: 535043
  misc_feature: HIJSMM301AKAVY.46.35.D02.1.454.light.4.raw

SEQ ID NO: 540339 - DNA, 506 bp, Homo sapiens; identical to SEQ ID NO: 534969
  misc_feature: HIJSMM301AWMCE.18.37.D04.1.454.light.4.raw

SEQ ID NO: 540340 - DNA, 485 bp, Homo sapiens; identical to SEQ ID NO: 539315
  misc_feature: HIJSMM301BWPP0.3.88.H11.1.454.light.4.raw

SEQ ID NO: 540341 - DNA, 476 bp, Homo sapiens
  misc_feature: HIJSMM301CKKIG.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgactgtggctgca

SEQ ID NO: 540342 - DNA, 488 bp, Homo sapiens
  misc_feature: HIJSMM301DCJZH.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 540343 - DNA, 487 bp, Homo sapiens; identical to SEQ ID NO: 537009
  misc_feature: HIJSMM301D2OTH.12.88.H11.1.454.light.4.raw

SEQ ID NO: 540344 - DNA, 444 bp, Homo sapiens; identical to SEQ ID NO: 535027
  misc_feature: HIJSMM301B3PP2.8.73.G07.1.454.light.4.raw

SEQ ID NO: 540345 - DNA, 485 bp, Homo sapiens
  misc_feature: HIJSMM301BWKVT.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaaggtggaactcaaacgaactgtggctgcaccatctgtcttcatcttcccgccatctgactagtctacg

SEQ ID NO: 540346 - DNA, 472 bp, Homo sapiens
  misc_feature: HIJSMM301BECJS.52.59.F04.1.454.light.4.raw
cgcagtacgacacgaccggtgctcgatttagtacacacacttagggattggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaa

SEQ ID NO: 540347 - DNA, 480 bp, Homo sapiens
  misc_feature: HIJSMM301D6LV3.49.63.F08.1.454.light.4.raw
agtcgagagacacgaccggtgctcgatttagcgatcgtataagggggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccagggaccaagctggagatcacacgaactgtggctgcaccatctgtcttcatccttcccgcat

SEQ ID NO: 540348 - DNA, 490 bp, Homo sapiens
  misc_feature: HIJSMM301EXUYV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactacatgatttattgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctacggt

SEQ ID NO: 540349 - DNA, 484 bp, Homo sapiens; identical to SEQ ID NO: 535211
  misc_feature: HIJSMM301B5R7Z.47.46.E02.1.454.light.4.raw

SEQ ID NO: 540350 - DNA, 504 bp, Homo sapiens
  misc_feature: HIJSMM301CTY8W.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctcg

SEQ ID NO: 540351 - DNA, 485 bp, Homo sapiens; identical to SEQ ID NO: 535963
  misc_feature: HIJSMM301AYN9L.15.28.C06.1.454.light.4.raw

SEQ ID NO: 540352 - DNA, 488 bp, Homo sapiens; identical to SEQ ID NO: 539612
  misc_feature: HIJSMM301EFB9R.3.55.E11.1.454.light.4.raw

SEQ ID NO: 540353 - DNA, 495 bp, Homo sapiens
  misc_feature: HIJSMM301EVG8F.27.78.H01.1.454.light.4.raw
  modified_base (483)..(483): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaaactgtggctgnaccatctgtctt

SEQ ID NO: 540354 - DNA, 508 bp, Homo sapiens
  misc_feature: HIJSMM301DF6AT.3.79.H02.1.454.light.4.raw
agacgcactccacgaccggtgctcgatttagtgtcacacgaaggggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaacgcccccaaactcatcatttatgatgtcactgctcggccctcgaggggtttctcatcgtcttttctggctccaagtctggcaccacggcctccctgaccatctcggggctccaggctgaggacgaggctgcttattactgcagctcatatacaaggagcaccactctcgtggtattggtggaggaccaagctgaccgtctaggtcagcccaaggctcgccccctcggt

SEQ ID NO: 540355 - DNA, 516 bp, Homo sapiens
  misc_feature: HIJSMM301COF8C.48.53.E09.1.454.light.4.raw
agtatacatacacgaccggtgctcgatttagagagagtgtgttgggtttggggggcgtcaggaggcagagctctgggaatctcaccatggcctggacccctcctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccgaccctcct

SEQ ID NO: 540356 - DNA, 487 bp, Homo sapiens; identical to SEQ ID NO: 536006
  misc_feature: HIJSMM301EIHWE.4.64.F09.1.454.light.4.raw

SEQ ID NO: 540357 - DNA, 494 bp, Homo sapiens; identical to SEQ ID NO: 534994
  misc_feature: HIJSMM301C38CG.27.78.H01.1.454.light.4.raw

SEQ ID NO: 540358 - DNA, 526 bp, Homo sapiens
  misc_feature: HIJSMM301AUYPF.52.61.F06.1.454.light.4.raw
cgcagtacgacacgaccggtgctcgatttagctacgctctaagggaaagggggctggggtctcaggaggcagcgctctcgggacgtctccaccatggcctgggctctgctattcctcaccctcctcactcatggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccaccctcct

SEQ ID NO: 540359 - DNA, 484 bp, Homo sapiens
  misc_feature: HIJSMM301AGXSC.46.26.C04.1.454.light.4.raw
  modified_base (431)..(431): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagntctacaagtcccgctcactttcggcggagggaccaaggtggagatcaaacgaa

SEQ ID NO: 540360 - DNA, 480 bp, Homo sapiens; identical to SEQ ID NO: 535291
  misc_feature: HIJSMM301AL2CC.22.59.F04.1.454.light.4.raw

SEQ ID NO: 540361 - DNA, 505 bp, Homo sapiens
  misc_feature: HIJSMM301ASJO7.10.27.C05.1.454.light.4.raw
catagtagtgcacgaccggtgctcgatttagacgcgatcgaagggtttgggggggtcgacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 540362 - DNA, 503 bp, Homo sapiens
  misc_feature: HIJSMM301B16F3.49.83.H06.1.454.light.4.raw
agtcgagagacacgaccggtgctcgatttagatcacgtgcgtcgcgggggaagagctgctcagttaggacccagagggaaccatggaaaccccagcgcagcttctcttcctcctgctactctggctcccagatattaccggagaaattgtgttgacgcagtctccaggcaccctgtccttgtctccaggggaaagagccaccctctcctgcagggccagtcacactgttagcagcacccacttagcctggtatcagcagaaacctggccagcctcccagactcctcatctctggtgcatccagcagggccactggcatcccagacaggttcagtggcagtgggtctgggacagacttcactctcaccatcagtagactggagcctgaagatttcgcagtgtattactgtcagcaattcaatatgtcacccccggacgttcggcccacgggaccgaacggtaggaaagtacaaacgaacctagtggcgtgcaccactctgtctt

SEQ ID NO: 540363 - DNA, 485 bp, Homo sapiens
  misc_feature: HIJSMM301B8R9D.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaactcctgatctatgctgcatccagtttgcatagtggggtcccatctaggttcagtggcagtggatctgggacagattttcactctcaccatcagcagtctgcaacctgaagattttgcaacttactactgtcaacagagttacggtaccccgtacacttttgcacgggacgaactaggacatcaacgaaactgtggctgcaccatctgtt

SEQ ID NO: 540364 - DNA, 448 bp, Homo sapiens
  misc_feature: HIJSMM301A99KG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatactcgta

SEQ ID NO: 540365 - DNA, 484 bp, Homo sapiens; identical to SEQ ID NO: 535240
  misc_feature: HIJSMM301AMCEX.47.60.F05.1.454.light.4.raw

SEQ ID NO: 540366 - DNA, 495 bp, Homo sapiens; identical to SEQ ID NO: 535821
  misc_feature: HIJSMM301DAHI6.3.31.C09.1.454.light.4.raw

SEQ ID NO: 540367 - DNA, 444 bp, Homo sapiens; identical to SEQ ID NO: 535192
  misc_feature: HIJSMM301DBND5.5.9.A09.1.454.light.4.raw

SEQ ID NO: 540368 - DNA, 515 bp, Homo sapiens
  misc_feature: HIJSMM301AQVWK.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccct

SEQ ID NO: 540369 - DNA, 498 bp, Homo sapiens
  misc_feature: HIJSMM301AKQ5M.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaaggaccaaggtggaatacaaacgaactagtggctgcacca

SEQ ID NO: 540370 - DNA, 443 bp, Homo sapiens
  misc_feature: HIJSMM301DWXXZ.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcag

SEQ ID NO: 540371 - DNA, 486 bp, Homo sapiens
  misc_feature: HIJSMM301AQZ3M.43.73.G07.1.454.light.4.raw
tgtgagtagtcacgaccggtgctcgatttagctctacgctcagggcacgaccggtgctcgatttagctctacgctcaggggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctaca

SEQ ID NO: 540372 - DNA, 441 bp, Homo sapiens; identical to SEQ ID NO: 535074
  misc_feature: HIJSMM301DQ3R1.11.3.A03.1.454.light.4.raw

SEQ ID NO: 540373 - DNA, 504 bp, Homo sapiens
  misc_feature: HIJSMM301AV56A.48.41.D08.1.454.light.4.raw
agtatacatacacgaccggtgctcgatttagtcacgcgagaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaacgggacacgactggagattaaacgaactgtggctgcacca

SEQ ID NO: 540374 - DNA, 496 bp, Homo sapiens
  misc_feature: HIJSMM301C6O4N.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactcttcg

SEQ ID NO: 540375 - DNA, 470 bp, Homo sapiens
  misc_feature: HIJSMM301DX6SY.49.79.H02.1.454.light.4.raw
  modified_base (467)..(467): a, c, t, g, unknown or other
agtcgagagacacgaccggtgctcgatttagtgtcacacgaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttctaccatcagcaggctgcagcctgaagatattgcaacatattactgtcaacagtatgatcgtctccgctcactttcgtcgggggaccgaacggtggaggatcaagngaa

SEQ ID NO: 540376 - DNA, 505 bp, Homo sapiens
  misc_feature: HIJSMM301EQ1TU.48.36.D03.1.454.light.4.raw
agtatacatacacgaccggtgctcgatttagctgcgtcacgatctctcttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcta

SEQ ID NO: 540377 - DNA, 498 bp, Homo sapiens; identical to SEQ ID NO: 536173
  misc_feature: HIJSMM301CSH3O.12.86.H09.1.454.light.4.raw

SEQ ID NO: 540378 - DNA, 490 bp, Homo sapiens
  misc_feature: HIJSMM301AKKUE.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactagtggctgcacca

SEQ ID NO: 540379 - DNA, 487 bp, Homo sapiens; identical to SEQ ID NO: 535704
  misc_feature: HIJSMM301BUUDG.52.83.H06.1.454.light.4.raw

SEQ ID NO: 540380 - DNA, 494 bp, Homo sapiens
  misc_feature: HIJSMM301D4ZAE.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccaatcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 540381 - DNA, 489 bp, Homo sapiens
  misc_feature: HIJSMM301BJ7ZC.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcact

SEQ ID NO: 540382 - DNA, 471 bp, Homo sapiens; identical to SEQ ID NO: 537461
  misc_feature: HIJSMM301B5QQX.7.81.H04.1.454.light.4.raw

SEQ ID NO: 540383 - DNA, 502 bp, Homo sapiens; identical to SEQ ID NO: 536253
  misc_feature: HIJSMM301BGAI3.21.22.B11.1.454.light.4.raw

SEQ ID NO: 540384 - DNA, 485 bp, Homo sapiens
  misc_feature: HIJSMM301C2JVO.49.60.F05.1.454.light.4.raw
agtcgagagacacgaccggtgctcgatttagtacgtcatcagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatacaaacgaa

SEQ ID NO: 540385 - DNA, 486 bp, Homo sapiens
  misc_feature: HIJSMM301C0YEM.46.35.D02.1.454.light.4.raw
  modified_base (376)..(376): a, c, t, g, unknown or other
actagcagtacacgaccggtgctcgatttagcacacgatagttgggtttggggagctgctcagttaggacccacgagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcngactggagcctgagattttgcagtctattactgtcagcagtatggtcacgtcccaagaacttttggccaggggaccaagctggagatacaacgaactgtggctgcaccat

SEQ ID NO: 540386 - DNA, 496 bp, Homo sapiens
  misc_feature: HIJSMM301EBQR9.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattcc

SEQ ID NO: 540387 - DNA, 494 bp, Homo sapiens; identical to SEQ ID NO: 534994
  misc_feature: HIJSMM301AMP0Q.27.78.H01.1.454.light.4.raw

SEQ ID NO: 540388 - DNA, 480 bp, Homo sapiens; identical to SEQ ID NO: 535291
  misc_feature: HIJSMM301DEF3T.22.59.F04.1.454.light.4.raw

SEQ ID NO: 540389 - DNA, 488 bp, Homo sapiens
  misc_feature: HIJSMM301BDTKP.9.75.G09.1.454.light.4.raw
tgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtcttcatt

SEQ ID NO: 540390 - DNA, 488 bp, Homo sapiens
  misc_feature: HIJSMM301ALTEY.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgtccccccg

SEQ ID NO: 540391 - DNA, 473 bp, Homo sapiens
  misc_feature: HIJSMM301ETB1B.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtca

SEQ ID NO: 540392 - DNA, 481 bp, Homo sapiens
  misc_feature: HIJSMM301AE7JU.43.63.F08.1.454.light.4.raw
  modified_base (452)..(452): a, c, t, g, unknown or other
tgtgagtagtcacgaccggtgctcgatttagcgatcgtataagggggagtcagacccactcaggacacagcatggacatgagggtccccgcctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagctttcactctcaccgtcagcagcctgcagtctgaagattttgcaacttattactgtctacaagattcttcttaccctcggacgttcgcgacgggacgaccggtggngtgtcaagcgaactgtggcgtgcaccact

SEQ ID NO: 540393 - DNA, 499 bp, Homo sapiens
  misc_feature: HIJSMM301A6IEO.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccgaaggtggaaagtacaaacgaactagtggctgcaccatctgtctt

SEQ ID NO: 540394 - DNA, 485 bp, Homo sapiens
  misc_feature: HIJSMM301B5HVW.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatacaaacgaa

SEQ ID NO: 540395 - DNA, 505 bp, Homo sapiens
  misc_feature: HIJSMM301BLP84.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggtcggagggaccaagctgaccgtcctcggtcagcccaaggctgccccctcggtcactctgttcccgccctccc

SEQ ID NO: 540396 - DNA, 505 bp, Homo sapiens; identical to SEQ ID NO: 536254
  misc_feature: HIJSMM301DAWPD.7.71.G05.1.454.light.4.raw

SEQ ID NO: 540397 - DNA, 481 bp, Homo sapiens; identical to SEQ ID NO: 535993
  misc_feature: HIJSMM301BR4FQ.21.25.C03.1.454.light.4.raw

SEQ ID NO: 540398 - DNA, 496 bp, Homo sapiens
  misc_feature: HIJSMM301AINZE.51.24.C02.1.454.light.4.raw
cgatcgtatacacgaccggtgctcgatttagtacagatcgttagggaaagggggatctgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaacgaactgtgg

SEQ ID NO: 540399 - DNA, 497 bp, Homo sapiens; identical to SEQ ID NO: 539058
  misc_feature: HIJSMM301DFQO5.12.87.H10.1.454.light.4.raw

SEQ ID NO: 540400 - DNA, 521 bp, Homo sapiens
  misc_feature: HIJSMM301CBFUO.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 540401 - DNA, 447 bp, Homo sapiens; identical to SEQ ID NO: 535020
  misc_feature: HIJSMM301BA2MY.18.9.A09.1.454.light.4.raw

SEQ ID NO: 540402 - DNA, 483 bp, Homo sapiens
  misc_feature: HIJSMM301ALSG1.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcaccagactagagcctgaagattttgcagtttattactgtcagcagcgtaacaactggctctctttcggcggagggaccaaggtggagatcaaacgaactgtggctgcaccatctgtctt

SEQ ID NO: 540403 - DNA, 484 bp, Homo sapiens
  misc_feature: HIJSMM301DKG9T.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgtttcggccagggaccaaggtcgaaatgagacgaactgtggctgcaccatctgtctt

SEQ ID NO: 540404 - DNA, 490 bp, Homo sapiens
  misc_feature: HIJSMM301AZXQJ.4.4.A04.1.454.light.4.raw
agcactgtagcacgaccggtgctcgatttagagtagtgatcagggggagtcagactcagtcaggacacagcatggacatgagggtccccgcctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggtccaggggaccgaaggtcgaaatagaggacgaactagtggctgcaccatctgtcttcta

SEQ ID NO: 540405 - DNA, 477 bp, Homo sapiens
  misc_feature: HIJSMM301CG6SV.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggaggatcaaacgaactgtggctgca

SEQ ID NO: 540406 - DNA, 479 bp, Homo sapiens
  misc_feature: HIJSMM301BS4H8.52.75.G09.1.454.light.4.raw
cgcagtacgacacgaccggtgctcgatttagtatagacatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtt

SEQ ID NO: 540407 - DNA, 383 bp, Homo sapiens; identical to SEQ ID NO: 447524
  misc_feature: HIJSMM301BOU91.41.26.C04.1.454.light.4.raw

SEQ ID NO: 540408 - DNA, 487 bp, Homo sapiens
  misc_feature: HIJSMM301AVKVK.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggatttcaaacgaactgtggctgcacc

SEQ ID NO: 540409 - DNA, 490 bp, Homo sapiens
  misc_feature: HIJSMM301CDA4F.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatt

SEQ ID NO: 540410 - DNA, 483 bp, Homo sapiens
  misc_feature: HIJSMM301AIA4U.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatatggatatcaaacgaactagtggctgcaccatctgtt

SEQ ID NO: 540411 - DNA, 434 bp, Homo sapiens; identical to SEQ ID NO: 535153
  misc_feature: HIJSMM301BB9YG.18.5.A05.1.454.light.4.raw

SEQ ID NO: 540412 - DNA, 463 bp, Homo sapiens; identical to SEQ ID NO: 535062
  misc_feature: HIJSMM301DEPJY.11.73.G07.1.454.light.4.raw

SEQ ID NO: 540413 - DNA, 361 bp, Homo sapiens
  misc_feature: HIJSMM301ENHLC.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccaccctcctcgagtgcgtct

SEQ ID NO: 540414 - DNA, 484 bp, Homo sapiens
  misc_feature: HIJSMM301D19WZ.7.75.G09.1.454.light.4.raw
  modified_base (469)..(469): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacgacgactggagattaaacgaaacngtggctgcaccatct

SEQ ID NO: 540415 - DNA, 508 bp, Homo sapiens
  misc_feature: HIJSMM301B6E6K.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatacaaacgaactgtggctgcaccatctgtcttcta

SEQ ID NO: 540416 - DNA, 508 bp, Homo sapiens; identical to SEQ ID NO: 535649
  misc_feature: HIJSMM301D0371.47.55.E11.1.454.light.4.raw

SEQ ID NO: 540417 - DNA, 489 bp, Homo sapiens
  misc_feature: HIJSMM301DVKGM.19.57.F02.1.454.light.4.raw
tactctcgtgcacgaccggtgctcgatttagctcgatatagttgggtttggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtctt

SEQ ID NO: 540418 - DNA, 493 bp, Homo sapiens
  misc_feature: HIJSMM301CX79K.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagttattactgtcagcaatatttcgtgctccgtacacttttggccaggggacccaggtggagatcagacgaactgtggctgcaccatctgtcttcatcttcccg

SEQ ID NO: 540419 - DNA, 472 bp, Homo sapiens; identical to SEQ ID NO: 540175
  misc_feature: HIJSMM301EZCZ5.7.81.H04.1.454.light.4.raw

SEQ ID NO: 540420 - DNA, 447 bp, Homo sapiens; identical to SEQ ID NO: 535201
  misc_feature: HIJSMM301B6PWQ.18.9.A09.1.454.light.4.raw

SEQ ID NO: 540421 - DNA, 510 bp, Homo sapiens; identical to SEQ ID NO: 540313
  misc_feature: HIJSMM301BAYKL.48.11.A11.1.454.light.4.raw

SEQ ID NO: 540422 - DNA, 477 bp, Homo sapiens; identical to SEQ ID NO: 537931
  misc_feature: HIJSMM301CQKB9.48.5.A05.1.454.light.4.raw

SEQ ID NO: 540423 - DNA, 486 bp, Homo sapiens; identical to SEQ ID NO: 535523
  misc_feature: HIJSMM301CSQFN.22.73.G07.1.454.light.4.raw

SEQ ID NO: 540424 - DNA, 489 bp, Homo sapiens
  misc_feature: HIJSMM301BIPQT.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 540425 - DNA, 492 bp, Homo sapiens
  misc_feature: HIJSMM301CS3XF.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggctgagggaccaagctgaccgtcctaggtcagcccaaggctgccccctcggtcactctgttcccgcct

SEQ ID NO: 540426 - DNA, 478 bp, Homo sapiens
  misc_feature: HIJSMM301CFL5L.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttattctgccagcaatataatagttattggacttcggccaggggaccaaggtcgaaatgagacgaactgtggctgcacc

SEQ ID NO: 540427 - DNA, 454 bp, Homo sapiens; identical to SEQ ID NO: 536347
  misc_feature: HIJSMM301DVY39.19.86.H09.1.454.light.4.raw

SEQ ID NO: 540428 - DNA, 492 bp, Homo sapiens
  misc_feature: HIJSMM301BD5NA.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 540429 - DNA, 520 bp, Homo sapiens; identical to SEQ ID NO: 535773
  misc_feature: HIJSMM301A01NS.41.19.B08.1.454.light.4.raw

SEQ ID NO: 540430 - DNA, 494 bp, Homo sapiens; identical to SEQ ID NO: 539894
  misc_feature: HIJSMM301BMFND.16.53.E09.1.454.light.4.raw

SEQ ID NO: 540431 - DNA, 485 bp, Homo sapiens; identical to SEQ ID NO: 536040
  misc_feature: HIJSMM301BRPGR.15.1.A01.1.454.light.4.raw

SEQ ID NO: 540432 - DNA, 418 bp, Homo sapiens
  misc_feature: HIJSMM301DBKFH.18.78.H01.1.454.light.4.raw
tacgagtatgcacgaccggtgctcgatttagtgtgagtagtttgggtttgggggctttggtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 540433 - DNA, 486 bp, Homo sapiens; identical to SEQ ID NO: 535290
  misc_feature: HIJSMM301CGR5Y.3.12.B01.1.454.light.4.raw

SEQ ID NO: 540434 - DNA, 511 bp, Homo sapiens
  misc_feature: HIJSMM301B5JF7.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgacgtcctaagtcagcccaaggctgccccctcggtcactctgtt

SEQ ID NO: 540435 - DNA, 505 bp, Homo sapiens
  misc_feature: HIJSMM301D0D8O.7.71.G05.1.454.light.4.raw
cgtgtctctacacgaccggtgctcgatttagtgtcgtcgcaagagagagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctgaccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatacaacgaactgtggctgcaccatctgtctt

SEQ ID NO: 540436 - DNA, 494 bp, Homo sapiens; identical to SEQ ID NO: 536974
  misc_feature: HIJSMM301CK215.16.86.H09.1.454.light.4.raw

SEQ ID NO: 540437 - DNA, 494 bp, Homo sapiens
  misc_feature: HIJSMM301AM4FK.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttccccaccccctcgctacgtaga

SEQ ID NO: 540438 - DNA, 488 bp, Homo sapiens
  misc_feature: HIJSMM301A2R9E.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtcccgtcaaggttcagtggccgtggatctgggacagatttcactctcaccatcagcagtctccaacctgaagattttgcaatttactactgtcaacagagtgacaatacccctcagactttcggccctggaccgagagtggatatcaaacgaactgtggctgcaccatctgtcttcatt

SEQ ID NO: 540439 - DNA, 492 bp, Homo sapiens
  misc_feature: HIJSMM301ASKW3.49.28.C06.1.454.light.4.raw
agtcgagagacacgaccggtgctcgatttagagctcacgtattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 540440 - DNA, 383 bp, Homo sapiens; identical to SEQ ID NO: 447524
  misc_feature: HIJSMM301ADGRQ.41.26.C04.1.454.light.4.raw

SEQ ID NO: 540441 - DNA, 486 bp, Homo sapiens; identical to SEQ ID NO: 535043
  misc_feature: HIJSMM301D2DI0.46.35.D02.1.454.light.4.raw

SEQ ID NO: 540442 - DNA, 488 bp, Homo sapiens; identical to SEQ ID NO: 535081
  misc_feature: HIJSMM301C317I.26.23.C01.1.454.light.4.raw

SEQ ID NO: 540443 - DNA, 464 bp, Homo sapiens; identical to SEQ ID NO: 536640
  misc_feature: HIJSMM301DBTY9.26.78.H01.1.454.light.4.raw

SEQ ID NO: 540444 - DNA, 501 bp, Homo sapiens
  misc_feature: HIJSMM301BW3Y8.15.56.F01.1.454.light.4.raw
  modified_base (476)..(476): a, c, t, g, unknown or other
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactcngttcccaccctcctcgctacgtaga

SEQ ID NO: 540445 - DNA, 509 bp, Homo sapiens
  misc_feature: HIJSMM301A6SFH.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaacgtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactcctgttcccca

SEQ ID NO: 540446 - DNA, 496 bp, Homo sapiens
  misc_feature: HIJSMM301DYGQQ.52.41.D08.1.454.light.4.raw
cgcagtacgacacgaccggtgctcgatttagtcacgcgagaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 540447 - DNA, 504 bp, Homo sapiens; identical to SEQ ID NO: 535077
  misc_feature: HIJSMM301ETB8C.8.28.C06.1.454.light.4.raw

SEQ ID NO: 540448 - DNA, 500 bp, Homo sapiens
  misc_feature: HIJSMM301ED2BB.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtccttggtcagcccaaggctgccccctcggtaactctgtt

SEQ ID NO: 540449 - DNA, 502 bp, Homo sapiens
  misc_feature: HIJSMM301BIK4C.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcat

SEQ ID NO: 540450 - DNA, 496 bp, Homo sapiens
  misc_feature: HIJSMM301AU2M0.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaacgtaggacgatcaagcgaactcgtggcgtgcaccactctgt

SEQ ID NO: 540451 - DNA, 496 bp, Homo sapiens
  misc_feature: HIJSMM301CPRN6.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggatcaaacgaactgtggctgcaccatctgtcttcatt

SEQ ID NO: 540452 - DNA, 517 bp, Homo sapiens
  misc_feature: HIJSMM301AL5SJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaacggaccgaaggtggaaagtacaaacgaaacctagtggcgtgcaccactactcgttcttctactctttccccg

SEQ ID NO: 540453 - DNA, 355 bp, Homo sapiens
  misc_feature: HIJSMM301BG0L2.3.11.A11.1.454.light.4.raw
agacgcactccacgaccggtgctcgatttagctacgactgcagggccgagtgagactgttagcagcgagctacttagcctggtaccagcacaaacctggccaggctcccagtctcctcatctttggtgcatccagcgagggcccctggcatcccagacaggttcagtggcagtgggtctgggacagacttcactctcaccatcagcagactggagcctgaagattttgcagtgtattactagtcaggtctatggttactcacctcggttcagctttggccaggggaccaaggtgagatcaaacgactgtggctgcaccatctgtcttcatcttcccgccatctgagagtgcgtct

SEQ ID NO: 540454 - DNA, 444 bp, Homo sapiens; identical to SEQ ID NO: 535027
  misc_feature: HIJSMM301AFKHI.8.73.G07.1.454.light.4.raw

SEQ ID NO: 540455 - DNA, 483 bp, Homo sapiens; identical to SEQ ID NO: 535413
  misc_feature: HIJSMM301CTMSO.26.78.H01.1.454.light.4.raw

SEQ ID NO: 540456 - DNA, 505 bp, Homo sapiens
  misc_feature: HIJSMM301B7AQH.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagttacttcactctcaccatcagcagcctagagcctgaagattttgcagtttattactgtcagcagcgtgccactttcggcggaggtgccactttcggcggagggaccgaaataagaggtcaaacgaactgtggctgcaccatctgtcttcatt

SEQ ID NO: 540457 - DNA, 487 bp, Homo sapiens
  misc_feature: HIJSMM301BJQRG.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacacttttggtccaggggaccaaactgacgatcaaacgaactgtggctgcaccatctgt

SEQ ID NO: 540458 - DNA, 485 bp, Homo sapiens; identical to SEQ ID NO: 536040
  misc_feature: HIJSMM301D8R5G.15.1.A01.1.454.light.4.raw

SEQ ID NO: 540459 - DNA, 513 bp, Homo sapiens
  misc_feature: HIJSMM301A2QEQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtccaacgggaccgaacggtaggaaagtacaaacgaactagtggcgtgcaccactctcgtcttctactcttccccg

SEQ ID NO: 540460 - DNA, 511 bp, Homo sapiens
  misc_feature: HIJSMM301BY7TI.8.39.D06.1.454.light.4.raw
  modified_base (447)..(447): a, c, t, g, unknown or other
  modified_base (450)..(450): a, c, t, g, unknown or other
  modified_base (478)..(478): a, c, t, g, unknown or other
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgtcgcaggacgaagtagnganacacgaacagtggcgtgcacactctctnttctatcttccctcctactctcagacaacgcga

SEQ ID NO: 540461 - DNA, 493 bp, Homo sapiens
  misc_feature: HIJSMM301CLCDY.21.39.D06.1.454.light.4.raw
tcgtcgctcgcacgaccggtgctcgatttagtgacatctcgcagttctttgggggcaggagtcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaagcccctaaactcctgatctatgctgcatccagtttggaaagtggggtcccatcaaggttcagcggcagtggatctgggacagatttcactctcaccatcagcagcctgcagcctgaagattttgcaacttattattgtcaacaggctcacggtttccccggacttcgtcggagggaccgaaggtaggaggagtacaacgaaactagtggcgtgcacca

SEQ ID NO: 540462 - DNA, 513 bp, Homo sapiens
  misc_feature: HIJSMM301B0DJO.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 540463 - DNA, 454 bp, Homo sapiens; identical to SEQ ID NO: 535005
  misc_feature: HIJSMM301EPFHM.19.86.H09.1.454.light.4.raw

SEQ ID NO: 540464 - DNA, 489 bp, Homo sapiens; identical to SEQ ID NO: 536013
  misc_feature: HIJSMM301EMO40.26.23.C01.1.454.light.4.raw

SEQ ID NO: 540465 - DNA, 444 bp, Homo sapiens; identical to SEQ ID NO: 535192
  misc_feature: HIJSMM301CH5A6.5.9.A09.1.454.light.4.raw

SEQ ID NO: 540466 - DNA, 460 bp, Homo sapiens; identical to SEQ ID NO: 537107
  misc_feature: HIJSMM301B68KP.22.28.C06.1.454.light.4.raw

SEQ ID NO: 540467 - DNA, 499 bp, Homo sapiens
  misc_feature: HIJSMM301BR7V8.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgaggaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggcccaaccccacctgtcactccttcgg

SEQ ID NO: 540468 - DNA, 509 bp, Homo sapiens
  misc_feature: HIJSMM301B871A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagattttcactctcaccatcagcagcctgcaggctgaagatgtggcagtttattactgtcaacagttttctcgggcgtgtccaggaccgaacggtaggaagtacaacgaaaccagtaggcgtgcgaccactctgtcttctatcttccccg

SEQ ID NO: 540469 - DNA, 416 bp, Homo sapiens; identical to SEQ ID NO: 535308
  misc_feature: HIJSMM301AUOCW.16.46.E02.1.454.light.4.raw

SEQ ID NO: 540470 - DNA, 487 bp, Homo sapiens; identical to SEQ ID NO: 536536
  misc_feature: HIJSMM301CBTKA.26.45.E01.1.454.light.4.raw

SEQ ID NO: 540471 - DNA, 486 bp, Homo sapiens; identical to SEQ ID NO: 535043
  misc_feature: HIJSMM301EMDC7.46.35.D02.1.454.light.4.raw

SEQ ID NO: 540472 - DNA, 492 bp, Homo sapiens
  misc_feature: HIJSMM301CT8OP.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 540473 - DNA, 490 bp, Homo sapiens
  misc_feature: HIJSMM301EG9I6.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtctcggaactgcgaccaaggtcacgtcctggtcagcccaaggccaacccactgtca

SEQ ID NO: 540474 - DNA, 510 bp, Homo sapiens
  misc_feature: HIJSMM301DIS0T.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgtgtctgat

SEQ ID NO: 540475 - DNA, 446 bp, Homo sapiens
  misc_feature: HIJSMM301CHE5S.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatatcgta

SEQ ID NO: 540476 - DNA, 477 bp, Homo sapiens
  misc_feature: HIJSMM301CNJHN.41.8.A08.1.454.light.4.raw
tctatactatcacgaccggtgctcgatttagcatactctacaggggaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcacca

SEQ ID NO: 540477 - DNA, 444 bp, Homo sapiens
  misc_feature: HIJSMM301AMF3Q.17.21.B10.1.454.light.4.raw
cgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcatcttcccgccatctgactagtctacg

SEQ ID NO: 540478 - DNA, 473 bp, Homo sapiens; identical to SEQ ID NO: 538793
  misc_feature: HIJSMM301ARSJK.5.34.D01.1.454.light.4.raw

SEQ ID NO: 540479 - DNA, 504 bp, Homo sapiens
  misc_feature: HIJSMM301EXOM4.8.19.B08.1.454.light.4.raw
ctcgcgtgtccacgaccggtgctcgatttagtgagtcagtaaggggaggaactgctcagttaggacccagagggaaccatggaagccccagctcagcttctcttcctcctgctactctggctcccagataccaccggagagattgtgttgacacagtctccagccaccctgtctttgctccaggggaaagagccaccctctcctgcagggtcagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactgtggctgcaccatctgtcttcatcttcccgccat

SEQ ID NO: 540480 - DNA, 482 bp, Homo sapiens
  misc_feature: HIJSMM301ETH0N.52.53.E09.1.454.light.4.raw
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgttgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctg

SEQ ID NO: 540481 - DNA, 497 bp, Homo sapiens
  misc_feature: HIJSMM301ECSLA.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgagatcagcagggtggaggctgaggatgttgcggtttattactgcctgcagagtattcactggccgtggacgttcggccaagggaccaaggtggaaatcaaacgaactgtggctgcacc

SEQ ID NO: 540482 - DNA, 507 bp, Homo sapiens
  misc_feature: HIJSMM301EJ5EE.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctcccaggctgaggacgaggcggattattactgttgctcatatgcgggtagtagcactttcgatgtcctattcggcggagggaccaagctgaccgtcctgggtcagcccaaggctgccccctccggtcactctgttcccgccctcctctacgtcgtat

SEQ ID NO: 540483 - DNA, 504 bp, Homo sapiens; identical to SEQ ID NO: 535128
  misc_feature: HIJSMM301DHUYM.19.85.H08.1.454.light.4.raw

SEQ ID NO: 540484 - DNA, 500 bp, Homo sapiens
  misc_feature: HIJSMM301D8A7Z.48.73.G07.1.454.light.4.raw
agtatacatacacgaccggtgctcgatttagctctacgctcagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 540485 - DNA, 354 bp, Homo sapiens
  misc_feature: HIJSMM301D1KXU.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 540486 - DNA, 506 bp, Homo sapiens
  misc_feature: HIJSMM301CCNYW.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcta

SEQ ID NO: 540487 - DNA, 487 bp, Homo sapiens; identical to SEQ ID NO: 536206
  misc_feature: HIJSMM301BU10I.47.38.D05.1.454.light.4.raw

SEQ ID NO: 540488 - DNA, 484 bp, Homo sapiens; identical to SEQ ID NO: 535400
  misc_feature: HIJSMM301EBCY0.46.26.C04.1.454.light.4.raw

SEQ ID NO: 540489 - DNA, 484 bp, Homo sapiens
  misc_feature: HIJSMM301BQTF7.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccagggacacgactggagattaaacgaactgtggctgcaccatctgt

SEQ ID NO: 540490 - DNA, 514 bp, Homo sapiens
  misc_feature: HIJSMM301ETBNY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaacgggaccgaaggtaggaaagtacaaaacgaaacctagtggctgcaccatctgtcttctatcttccccg

SEQ ID NO: 540491 - DNA, 486 bp, Homo sapiens; identical to SEQ ID NO: 535043
  misc_feature: HIJSMM301B4EZ1.46.35.D02.1.454.light.4.raw

SEQ ID NO: 540492 - DNA, 503 bp, Homo sapiens; identical to SEQ ID NO: 538256
  misc_feature: HIJSMM301DCUV8.19.67.G01.1.454.light.4.raw

SEQ ID NO: 540493 - DNA, 501 bp, Homo sapiens
  misc_feature: HIJSMM301B73NE.18.11.A11.1.454.light.4.raw
tacgagtatgcacgaccggtgctcgatttagctacgactgcagggggagctacaacaggcaggcaggggcagcaagatggtgttgcagacccaggtctccatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtctt

SEQ ID NO: 540494 - DNA, 498 bp, Homo sapiens; identical to SEQ ID NO: 536173
  misc_feature: HIJSMM301BF7M9.12.86.H09.1.454.light.4.raw

SEQ ID NO: 540495 - DNA, 493 bp, Homo sapiens
  misc_feature: HIJSMM301C6LHA.12.38.D05.1.454.light.4.raw
atacgacgtacacgaccggtgctcgatttagtatctgatagttgggtttggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagagttgttacaagtacgttcggcggacggacgaaggtggagatacaaacgaactgtggctgcaccatctgttcttc

SEQ ID NO: 540496 - DNA, 447 bp, Homo sapiens
  misc_feature: HIJSMM301CJ7GT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccactgtcactctgttcccaccctcctccatactcgta

SEQ ID NO: 540497 - DNA, 515 bp, Homo sapiens; identical to SEQ ID NO: 540368
  misc_feature: HIJSMM301EMSDW.16.88.H11.1.454.light.4.raw

SEQ ID NO: 540498 - DNA, 486 bp, Homo sapiens; identical to SEQ ID NO: 535458
  misc_feature: HIJSMM301CV95R.7.75.G09.1.454.light.4.raw

SEQ ID NO: 540499 - DNA, 503 bp, Homo sapiens
  misc_feature: HIJSMM301CV8ND.52.6.A06.1.454.light.4.raw
cgcagtacgacacgaccggtgctcgatttagatctactgacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaagcagaaacacttgggtgttcggcggcgggaccaaactgaccgtcctacgtcagcccaaggctgcccctcggtcact

SEQ ID NO: 540500 - DNA, 443 bp, Homo sapiens
  misc_feature: HIJSMM301DP1AN.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccccctccgtgtctaat

SEQ ID NO: 540501 - DNA, 441 bp, Homo sapiens; identical to SEQ ID NO: 534971
  misc_feature: HIJSMM301A8R5C.11.3.A03.1.454.light.4.raw

SEQ ID NO: 540502 - DNA, 484 bp, Homo sapiens; identical to SEQ ID NO: 535240
  misc_feature: HIJSMM301D4RLH.47.60.F05.1.454.light.4.raw

SEQ ID NO: 540503 - DNA, 447 bp, Homo sapiens; identical to SEQ ID NO: 535201
  misc_feature: HIJSMM301CMASA.18.9.A09.1.454.light.4.raw

SEQ ID NO: 540504 - DNA, 487 bp, Homo sapiens; identical to SEQ ID NO: 536179
  misc_feature: HIJSMM301C1KGU.19.57.F02.1.454.light.4.raw

SEQ ID NO: 540505 - DNA, 476 bp, Homo sapiens; identical to SEQ ID NO: 537368
  misc_feature: HIJSMM301CJWIJ.7.83.H06.1.454.light.4.raw

SEQ ID NO: 540506 - DNA, 461 bp, Homo sapiens
  misc_feature: HIJSMM301BNIQN.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactctcatctatactaataatcaccggccctcagggatccctgaccgattctctgcctccaagtctggcacctcagcctccctggccatcagtcggctccagtctgaggatgagggctgattattactgtgcagcatactatgacaccctgaatggtctttgggtgttcggcggagggaccaagctgaccgtccctaggtcagcccaaggctgccccctccggtcactctgttcccgaccctccctctagtacgtga

SEQ ID NO: 540507 - DNA, 493 bp, Homo sapiens
  misc_feature: HIJSMM301ATOCV.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatactaccactcactttcgtcggagggacgaccgtggaggatcaaacgaaactagtggcgtgcaccaactctgtcttcta

SEQ ID NO: 540508 - DNA, 482 bp, Homo sapiens
  misc_feature: HIJSMM301CR014.43.64.F09.1.454.light.4.raw
tgtgagtagtcacgaccggtgctcgatttagcgcgtatacaagggggagtcagtctcagtcaggacacagcatggacatgagggtccccgctcagctcctggggctcctgctactctggctccgaggtggcagatgtgacatccagatgacccagtctccatcctccctgtctgcatctgtgggggacagagtcaccatcacttgtcgggcaagtcagtccgttaggcattatttaaattggtatcggcagagaccagggatggcccctcagctcatgatctacgctgcttccactctgcaaattggggtcccatcaacgttcagtggcagtgggtctgggacatatttcactctcaccatcaccagtctggaacctgaagattttgcaacttacttctgccaacagacttacagtctccctctcactttcggcggagggaccacagtggagatcaaaggaactgtggctgcaccatctgtt

SEQ ID NO: 540509 - DNA, 487 bp, Homo sapiens
  misc_feature: HIJSMM301D1E2Y.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaaactgtggctgcaccatctgt

SEQ ID NO: 540510 - DNA, 440 bp, Homo sapiens; identical to SEQ ID NO: 537271
  misc_feature: HIJSMM301BN9LS.41.9.A09.1.454.light.4.raw

SEQ ID NO: 540511 - DNA, 485 bp, Homo sapiens
  misc_feature: HIJSMM301EDU6L.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtcaaacgaaacctgtggctgcaccatctgtcttcta

SEQ ID NO: 540512 - DNA, 495 bp, Homo sapiens; identical to SEQ ID NO: 535486
  misc_feature: HIJSMM301B9QDL.26.72.G06.1.454.light.4.raw

SEQ ID NO: 540513 - DNA, 502 bp, Homo sapiens
  misc_feature: HIJSMM301DTP4N.47.55.E11.1.454.light.4.raw
agctcacgtacacgaccggtgctcgatttagcactcgcacgtaggatcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgccctctcta

SEQ ID NO: 540514 - DNA, 354 bp, Homo sapiens; identical to SEQ ID NO: 535026
  misc_feature: HIJSMM301BAX36.19.22.B11.1.454.light.4.raw

SEQ ID NO: 540515 - DNA, 481 bp, Homo sapiens
  misc_feature: HIJSMM301C9WF7.41.68.G02.1.454.light.4.raw
  modified_base (470)..(470): a, c, t, g, unknown or other
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccgaagtggagatcaaacgaacngtggctgcacc

SEQ ID NO: 540516 - DNA, 497 bp, Homo sapiens
  misc_feature: HIJSMM301AN6XN.52.55.E11.1.454.light.4.raw
cgcagtacgacacgaccggtgctcgatttagcactcgcacgttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 540517 - DNA, 485 bp, Homo sapiens; identical to SEQ ID NO: 536040
  misc_feature: HIJSMM301DFZOJ.15.1.A01.1.454.light.4.raw

SEQ ID NO: 540518 - DNA, 509 bp, Homo sapiens
  misc_feature: HIJSMM301CAUV0.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcacttcggcggggacgaacgtggagtctaacgaactgtggcgtgcgaccactctcgtcttctatctttcccgtcccc

SEQ ID NO: 540519 - DNA, 494 bp, Homo sapiens; identical to SEQ ID NO: 535276
  misc_feature: HIJSMM301A3VJ8.16.6.A06.1.454.light.4.raw

SEQ ID NO: 540520 - DNA, 506 bp, Homo sapiens; identical to SEQ ID NO: 539926
  misc_feature: HIJSMM301CQNFN.5.24.C02.1.454.light.4.raw

SEQ ID NO: 540521 - DNA, 482 bp, Homo sapiens
  misc_feature: HIJSMM301CML52.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggcggcgggacc

SEQ ID NO: 540522 - DNA, 501 bp, Homo sapiens
  misc_feature: HIJSMM301BB4TX.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccagggtccaagctggagatgaaacgaactagtggctgcaccatctgtcttcatcttccccg

SEQ ID NO: 540523 - DNA, 513 bp, Homo sapiens
  misc_feature: HIJSMM301DKM8P.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcatctgttcccgcctcctcg

SEQ ID NO: 540524 - DNA, 501 bp, Homo sapiens; identical to SEQ ID NO: 535873
  misc_feature: HIJSMM301DHCDI.17.27.C05.1.454.light.4.raw

SEQ ID NO: 540525 - DNA, 498 bp, Homo sapiens; identical to SEQ ID NO: 537020
  misc_feature: HIJSMM301BEHHY.26.26.C04.1.454.light.4.raw

SEQ ID NO: 540526 - DNA, 434 bp, Homo sapiens; identical to SEQ ID NO: 535153
  misc_feature: HIJSMM301BQDU7.18.5.A05.1.454.light.4.raw

SEQ ID NO: 540527 - DNA, 444 bp, Homo sapiens; identical to SEQ ID NO: 535027
  misc_feature: HIJSMM301CH7OH.8.73.G07.1.454.light.4.raw

SEQ ID NO: 540528 - DNA, 501 bp, Homo sapiens
  misc_feature: HIJSMM301AG2JQ.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 540529 - DNA, 502 bp, Homo sapiens
  misc_feature: HIJSMM301CK3HP.52.33.C11.1.454.light.4.raw
cgcagtacgacacgaccggtgctcgatttagagtgagctcgttgggtttgggggctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttcccgccta

SEQ ID NO: 540530 - DNA, 495 bp, Homo sapiens
  misc_feature: HIJSMM301DJSQ8.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggtcagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 540531 - DNA, 483 bp, Homo sapiens
  misc_feature: HIJSMM301B1412.49.35.D02.1.454.light.4.raw
agtcgagagacacgaccggtgctcgatttagcacacgatagttgggtttgggggagtcagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgcacca

SEQ ID NO: 540532 - DNA, 484 bp, Homo sapiens; identical to SEQ ID NO: 535211
  misc_feature: HIJSMM301DZ83I.47.46.E02.1.454.light.4.raw

SEQ ID NO: 540533 - DNA, 420 bp, Homo sapiens
  misc_feature: HIJSMM301CI7IH.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 540534 - DNA, 482 bp, Homo sapiens; identical to SEQ ID NO: 539800
  misc_feature: HIJSMM301ASES2.21.25.C03.1.454.light.4.raw

SEQ ID NO: 540535 - DNA, 498 bp, Homo sapiens
  misc_feature: HIJSMM301D9RSW.41.40.D07.1.454.light.4.raw
tctatactatcacgaccggtgctcgatttagtgatagagcgtaacaacagagggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 540536 - DNA, 491 bp, Homo sapiens; identical to SEQ ID NO: 536211
  misc_feature: HIJSMM301B1F25.16.53.E09.1.454.light.4.raw

SEQ ID NO: 540537 - DNA, 512 bp, Homo sapiens
  misc_feature: HIJSMM301BD4MK.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatacaaacgaactagtggcgtgcaccatctgtcttcta

SEQ ID NO: 540538 - DNA, 504 bp, Homo sapiens
  misc_feature: HIJSMM301DOY3I.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtt

SEQ ID NO: 540539 - DNA, 505 bp, Homo sapiens
  misc_feature: HIJSMM301A7ISS.48.28.C06.1.454.light.4.raw
agtatacatacacgaccggtgctcgatttagagctcacgtattgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 540540 - DNA, 380 bp, Homo sapiens
  misc_feature: HIJSMM301BX6DS.12.78.H01.1.454.light.4.raw
atacgacgtacacgaccggtgctcgatttagtgtgagtagtttgggtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtat

SEQ ID NO: 540541 - DNA, 484 bp, Homo sapiens
  misc_feature: HIJSMM301BVCW7.26.70.G04.1.454.light.4.raw
agactatactcacgaccggtgctcgatttagtgtagtgtgaagggaaaggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctaggaaactaacgaactgtggctgcacc

SEQ ID NO: 540542 - DNA, 464 bp, Homo sapiens
  misc_feature: HIJSMM301E0ILX.52.2.A02.1.454.light.4.raw
cgcagtacgacacgaccggtgctcgatttagactcatctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaa

SEQ ID NO: 540543 - DNA, 519 bp, Homo sapiens
  misc_feature: HIJSMM301AQ6FA.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactcgtcactctcg

SEQ ID NO: 540544 - DNA, 494 bp, Homo sapiens; identical to SEQ ID NO: 534992
  misc_feature: HIJSMM301BCG6M.9.1.A01.1.454.light.4.raw

SEQ ID NO: 540545 - DNA, 454 bp, Homo sapiens; identical to SEQ ID NO: 534964
  misc_feature: HIJSMM301AHH9A.19.86.H09.1.454.light.4.raw

SEQ ID NO: 540546 - DNA, 445 bp, Homo sapiens; identical to SEQ ID NO: 535913
  misc_feature: HIJSMM301C43B8.5.9.A09.1.454.light.4.raw

SEQ ID NO: 540547 - DNA, 448 bp, Homo sapiens
  misc_feature: HIJSMM301EAO2D.18.9.A09.1.454.light.4.raw
  modified_base (429)..(429): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccncccctcctccatactcgta

SEQ ID NO: 540548 - DNA, 500 bp, Homo sapiens
  misc_feature: HIJSMM301EG84V.48.41.D08.1.454.light.4.raw
agtatacatacacgaccggtgctcgatttagtcacgcgagaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgcc

SEQ ID NO: 540549 - DNA, 493 bp, Homo sapiens
  misc_feature: HIJSMM301EP6JM.12.23.C01.1.454.light.4.raw
  modified_base (463)..(463): a, c, t, g, unknown or other
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcaactttcggcggggaccgaagtaggngatcaacgaaactgtggcgtgcaccactct

SEQ ID NO: 540550 - DNA, 510 bp, Homo sapiens
  misc_feature: HIJSMM301CW4KO.9.81.H04.1.454.light.4.raw
tgatacgtctcacgaccggtgctcgatttagtagtgtagattcgcgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaacgtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaaggtgggaccgaccggtcacccgtcctaggtcacgcccaaggccaaccccactgtcacttcc

SEQ ID NO: 540551 - DNA, 462 bp, Homo sapiens
  misc_feature: HIJSMM301BDH2L.49.28.C06.1.454.light.4.raw
agtcgagagacacgaccggtgctcgatttagagctcacgtattgggtttggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggacgaacgtggagatcagcga

SEQ ID NO: 540552 - DNA, 514 bp, Homo sapiens
  misc_feature: HIJSMM301DW4J5.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 540553 - DNA, 491 bp, Homo sapiens
  misc_feature: HIJSMM301CJK14.27.78.H01.1.454.light.4.raw
  modified_base (489)..(489): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcaccttcgcaacggacacgactggagataaacgtaaactgtggctgcaccatctgtntt

SEQ ID NO: 540554 - DNA, 441 bp, Homo sapiens; identical to SEQ ID NO: 534971
  misc_feature: HIJSMM301DRTON.11.3.A03.1.454.light.4.raw

SEQ ID NO: 540555 - DNA, 476 bp, Homo sapiens
  misc_feature: HIJSMM301BPBPS.49.49.E05.1.454.light.4.raw
agtcgagagacacgaccggtgctcgatttagagcgactagcaacacacaaagggggcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcctgcactgggagcagctccaacatcggggcaggttatgatgtacactggtatcagcagcttcccggaacagcccccaaactcctcatctatgatgacattaagcggccctcgggggtccctgaccgattctctggctccaagtctggcaccgcagcctccctggccatcactgggctccaggctgaggatgaggctgattattactgccagacctatgacaccagcctgactgtcgtggtcttcggcggagggacc

SEQ ID NO: 540556 - DNA, 488 bp, Homo sapiens
  misc_feature: HIJSMM301BF6OK.4.4.A04.1.454.light.4.raw
agcactgtagcacgaccggtgctcgatttagagtagtgatcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgtcgggcaagtcagagtattaatagttggttggcctggtatcaccagagaccaggagaggccccaaggctccttatttatgatgcctccactgtgattagtggggtcccaccaacgttcagcggcagtggatctgggacatacttcactctcaccatcagcagcctgcagcctgatgatcttggaacttattactgccaacagtataatagtttttggacgttcggtccaggggaccgaaggtacgaaatagagacgaactgtggctgcaccatctgtcttcta

SEQ ID NO: 540557 - DNA, 487 bp, Homo sapiens
  misc_feature: HIJSMM301A3KEO.41.44.D11.1.454.light.4.raw
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaa

SEQ ID NO: 540558 - DNA, 486 bp, Homo sapiens; identical to SEQ ID NO: 535043
  misc_feature: HIJSMM301BP4M1.46.35.D02.1.454.light.4.raw

SEQ ID NO: 540559 - DNA, 441 bp, Homo sapiens; identical to SEQ ID NO: 534971
  misc_feature: HIJSMM301A61ER.11.3.A03.1.454.light.4.raw

SEQ ID NO: 540560 - DNA, 506 bp, Homo sapiens; identical to SEQ ID NO: 536355
  misc_feature: HIJSMM301DQ6PD.47.85.H08.1.454.light.4.raw

SEQ ID NO: 540561 - DNA, 485 bp, Homo sapiens
  misc_feature: HIJSMM301A1A4A.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactagtggctgcaccta

SEQ ID NO: 540562 - DNA, 472 bp, Homo sapiens
  misc_feature: HIJSMM301BZPC2.52.32.C10.1.454.light.4.raw
cgcagtacgacacgaccggtgctcgatttagtatagacatcaacacacaaaggggcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaagtggagatcaagcgaactgtgg

SEQ ID NO: 540563 - DNA, 489 bp, Homo sapiens; identical to SEQ ID NO: 535139
  misc_feature: HIJSMM301EGZH2.14.55.E11.1.454.light.4.raw

SEQ ID NO: 540564 - DNA, 486 bp, Homo sapiens; identical to SEQ ID NO: 535458
  misc_feature: HIJSMM301EYF73.7.75.G09.1.454.light.4.raw

SEQ ID NO: 540565 - DNA, 508 bp, Homo sapiens
  misc_feature: HIJSMM301EPV8L.51.86.H09.1.454.light.4.raw
cgatcgtatacacgaccggtgctcgatttagtgctatagacttgggtttgggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcta

SEQ ID NO: 540566 - DNA, 483 bp, Homo sapiens; identical to SEQ ID NO: 535413
  misc_feature: HIJSMM301A5WKO.26.78.H01.1.454.light.4.raw

SEQ ID NO: 540567 - DNA, 448 bp, Homo sapiens
  misc_feature: HIJSMM301B5W18.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccaccctcctccatactcgta

SEQ ID NO: 540568 - DNA, 490 bp, Homo sapiens
  misc_feature: HIJSMM301ELKO5.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaaactgtggctgcaccat

SEQ ID NO: 540569 - DNA, 479 bp, Homo sapiens
  misc_feature: HIJSMM301EC0DE.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgca

SEQ ID NO: 540570 - DNA, 489 bp, Homo sapiens
  misc_feature: HIJSMM301CTCSX.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttatcttcggacctcgtccacggacgacggtaggaagtacaacgaaactagtggcgtcgcaccaactctgtcttctact

SEQ ID NO: 540571 - DNA, 444 bp, Homo sapiens; identical to SEQ ID NO: 535594
  misc_feature: HIJSMM301BHYL8.9.9.A09.1.454.light.4.raw

SEQ ID NO: 540572 - DNA, 494 bp, Homo sapiens; identical to SEQ ID NO: 534992
  misc_feature: HIJSMM301DRG7R.9.1.A01.1.454.light.4.raw

SEQ ID NO: 540573 - DNA, 513 bp, Homo sapiens
  misc_feature: HIJSMM301BI82N.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgggtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccacctcct

SEQ ID NO: 540574 - DNA, 501 bp, Homo sapiens
  misc_feature: HIJSMM301C6J7Y.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccacctcc

SEQ ID NO: 540575 - DNA, 487 bp, Homo sapiens; identical to SEQ ID NO: 536206
  misc_feature: HIJSMM301CVQFG.47.38.D05.1.454.light.4.raw

SEQ ID NO: 540576 - DNA, 484 bp, Homo sapiens; identical to SEQ ID NO: 535240
  misc_feature: HIJSMM301CRGAD.47.60.F05.1.454.light.4.raw

SEQ ID NO: 540577 - DNA, 495 bp, Homo sapiens
  misc_feature: HIJSMM301ES8CB.52.27.C05.1.454.light.4.raw
cgcagtacgacacgaccggtgctcgatttagacgcgatcgaagggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtca

SEQ ID NO: 540578 - DNA, 493 bp, Homo sapiens; identical to SEQ ID NO: 540127
  misc_feature: HIJSMM301A9JXM.10.17.B06.1.454.light.4.raw

SEQ ID NO: 540579 - DNA, 471 bp, Homo sapiens
  misc_feature: HIJSMM301BR5AA.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtgg

SEQ ID NO: 540580 - DNA, 484 bp, Homo sapiens; identical to SEQ ID NO: 535441
  misc_feature: HIJSMM301ELXLG.26.60.F05.1.454.light.4.raw

SEQ ID NO: 540581 - DNA, 484 bp, Homo sapiens
  misc_feature: HIJSMM301EELBV.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacc

SEQ ID NO: 540582 - DNA, 491 bp, Homo sapiens; identical to SEQ ID NO: 535176
  misc_feature: HIJSMM301A1VYA.13.39.D06.1.454.light.4.raw

SEQ ID NO: 540583 - DNA, 454 bp, Homo sapiens
  misc_feature: HIJSMM301CCCXK.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgagcggtccggttttcggcggagggaccaagctgaccgtcctaagtcagcccaaggctgccccctcggtcactctgttcccaccctcctccacgagagta

SEQ ID NO: 540584 - DNA, 487 bp, Homo sapiens
  misc_feature: HIJSMM301AK45F.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttggccaagggaccaaggtggaaatcaaacgaactagtggctgcaccatctgtcttcta

SEQ ID NO: 540585 - DNA, 470 bp, Homo sapiens; identical to SEQ ID NO: 536130
  misc_feature: HIJSMM301DMONM.7.81.H04.1.454.light.4.raw

SEQ ID NO: 540586 - DNA, 509 bp, Homo sapiens
  misc_feature: HIJSMM301DC040.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttgggggcaaagctgccctgacactgcctggtgtgcagcctgaggacgaggctgactattactgcctactctactttggtggtgctgtgctattcggcggagggaccaagctgaccgtcttaagtcagcccaaggctgccccctggtcactttgttcccacctcct

SEQ ID NO: 540587 - DNA, 504 bp, Homo sapiens; identical to SEQ ID NO: 535128
  misc_feature: HIJSMM301AM4JW.19.85.H08.1.454.light.4.raw

SEQ ID NO: 540588 - DNA, 486 bp, Homo sapiens
  misc_feature: HIJSMM301EKOJZ.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaaactgtggctgcaccatctgtcttcta

SEQ ID NO: 540589 - DNA, 415 bp, Homo sapiens; identical to SEQ ID NO: 535434
  misc_feature: HIJSMM301BQPCG.16.46.E02.1.454.light.4.raw

SEQ ID NO: 540590 - DNA, 500 bp, Homo sapiens; identical to SEQ ID NO: 537851
  misc_feature: HIJSMM301DAQYS.52.37.D04.1.454.light.4.raw

SEQ ID NO: 540591 - DNA, 517 bp, Homo sapiens
  misc_feature: HIJSMM301CTINJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaagtacgaaacgaactagtggcgtgcaccactctgtcttctatcttcccgtcccact

SEQ ID NO: 540592 - DNA, 489 bp, Homo sapiens; identical to SEQ ID NO: 535139
  misc_feature: HIJSMM301AJWGX.14.55.E11.1.454.light.4.raw

SEQ ID NO: 540593 - DNA, 489 bp, Homo sapiens; identical to SEQ ID NO: 537328
  misc_feature: HIJSMM301C89CG.13.5.A05.1.454.light.4.raw

SEQ ID NO: 540594 - DNA, 496 bp, Homo sapiens
  misc_feature: HIJSMM301AO79X.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaactgtggctgcaccatctgtctt

SEQ ID NO: 540595 - DNA, 497 bp, Homo sapiens
  misc_feature: HIJSMM301EAX06.22.38.D05.1.454.light.4.raw
acatacgcgtcacgaccggtgctcgatttagtatctgatagttgggtttggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtggtctgggacagacttcactctcaccatcagcgacctagagcctgaagattttgcagtttatactgtcagcagcgtagcatctggcctccgtacacctttggccaggggaccaagctggagatcaaacgactgtggctgcaccatctgtcttcattcc

SEQ ID NO: 540596 - DNA, 496 bp, Homo sapiens; identical to SEQ ID NO: 535109
  misc_feature: HIJSMM301AVO3U.16.78.H01.1.454.light.4.raw

SEQ ID NO: 540597 - DNA, 514 bp, Homo sapiens
  misc_feature: HIJSMM301DI4PH.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctcgccccctcggtcactctgttccca

SEQ ID NO: 540598 - DNA, 485 bp, Homo sapiens; identical to SEQ ID NO: 535880
  misc_feature: HIJSMM301DAOD6.7.75.G09.1.454.light.4.raw

SEQ ID NO: 540599 - DNA, 492 bp, Homo sapiens; identical to SEQ ID NO: 535939
  misc_feature: HIJSMM301CPPW3.13.5.A05.1.454.light.4.raw

SEQ ID NO: 540600 - DNA, 486 bp, Homo sapiens; identical to SEQ ID NO: 537428
  misc_feature: HIJSMM301DM9TR.47.62.F07.1.454.light.4.raw

SEQ ID NO: 540601 - DNA, 480 bp, Homo sapiens
  misc_feature: HIJSMM301BWYWV.40.21.B10.1.454.light.4.raw
tctagcgactcacgaccggtgctcgatttagtgtcgtcgcaaggggtgatcaggactcctcagttcaccttctcacaatgaggctccctgctcagctcctggggctgctaatgctctgggtcccagaattcagtggggatgttgtgatgactcagtctccactctccctgcccgtcacccttggacagccggcctccatctcctgcaggtctagtcaaagcctcactcgcagtgatggaagcacctacttgaattggtttcaccagaggccaggccaatctccgaggcgcctaatttgtgaggtttctaaccgcgactctggggtcccagacagattcagcggcagtgggtcaggcactgatttcacactgaaaatcagcagggtggaggctgaggatgttgggatttattactgcatgcaaggttcacactggcctccatacacttttggccaggggaccaagctggagatcaaacgaa

SEQ ID NO: 540602 - DNA, 487 bp, Homo sapiens; identical to SEQ ID NO: 536025
  misc_feature: HIJSMM301ESM8K.17.34.D01.1.454.light.4.raw

SEQ ID NO: 540603 - DNA, 514 bp, Homo sapiens
  misc_feature: HIJSMM301CZBXO.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaatatgtttattggtaccaacagaagtcaggccaggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccaccctcctc

SEQ ID NO: 540604 - DNA, 483 bp, Homo sapiens
  misc_feature: HIJSMM301DW0HU.11.17.B06.1.454.light.4.raw
cgagagataccacgaccggtgctcgatttagtcgatagtgaagggggcaggagtcagtctcagtcaggacacagcatggacatgagggtccccgctcagctcccggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccgaagtaggaaagtacaaacgaactagtggctgcacca

SEQ ID NO: 540605 - DNA, 507 bp, Homo sapiens; identical to SEQ ID NO: 538063
  misc_feature: HIJSMM301BKZ6E.47.85.H08.1.454.light.4.raw

SEQ ID NO: 540606 - DNA, 509 bp, Homo sapiens
  misc_feature: HIJSMM301E13GF.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctacttacgtcggacggacggaacgaggacgagtcacgacgaacgtacgtggtcgtcgtcgaccaactctcgttcgttcctta

SEQ ID NO: 540607 - DNA, 503 bp, Homo sapiens; identical to SEQ ID NO: 536834
  misc_feature: HIJSMM301CDT0E.2.35.D02.1.454.light.4.raw

SEQ ID NO: 540608 - DNA, 444 bp, Homo sapiens; identical to SEQ ID NO: 535027
  misc_feature: HIJSMM301DZHZA.8.73.G07.1.454.light.4.raw

SEQ ID NO: 540609 - DNA, 504 bp, Homo sapiens
  misc_feature: HIJSMM301DK4ME.47.55.E11.1.454.light.4.raw
agctcacgtacacgaccggtgctcgatttagcactcgcacgttgggtttggggcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaa

SEQ ID NO: 540610 - DNA, 443 bp, Homo sapiens
  misc_feature: HIJSMM301BUF8Z.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccagatctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgcccctcggtcactctgttcccaccctcctccgtgtctgat

SEQ ID NO: 540611 - DNA, 497 bp, Homo sapiens; identical to SEQ ID NO: 538296
  misc_feature: HIJSMM301DSSUP.18.11.A11.1.454.light.4.raw

SEQ ID NO: 540612 - DNA, 491 bp, Homo sapiens
  misc_feature: HIJSMM301AG56G.43.60.F05.1.454.light.4.raw
  modified_base (461)..(461): a, c, t, g, unknown or other
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccggcaagtcaggacattagaaatgaattagcctggtttcagcagaaaccagggaaagcccctaagctcctgatctatgctgcatccactttacaaaatggagtcccatcaagattcagcggcagtggatctggcacagtctttcactctcaccgtcagcagcctgcagtctgaagtattttgctaacttattactgtctacaagattcttcttacctcggtacgtcgtcgacggaccgacggtaggagtntcagacgaactgtgcgtgcaccactcttcg

SEQ ID NO: 540613 - DNA, 471 bp, Homo sapiens
  misc_feature: HIJSMM301EPAZ1.51.75.G09.1.454.light.4.raw
cgatcgtatacacgaccggtgctcgatttagtatagacatcagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggtaatgatgtacactggtaccagcagcttccaggaacagtccccaaactcctcatttatgctaacaccaatcggccctcaggggtccctgcccgattctctggctccaggtctggcacctcagcctccctggccatcactgggctccgggctgaggatgaggctgattattactgccagtcccatgacagcagcctgagtgtgctgttcggcggaggacc

SEQ ID NO: 540614 - DNA, 484 bp, Homo sapiens; identical to SEQ ID NO: 540155
  misc_feature: HIJSMM301COP3M.4.29.C07.1.454.light.4.raw

SEQ ID NO: 540615 - DNA, 413 bp, Homo sapiens
  misc_feature: HIJSMM301B7CGC.10.38.D05.1.454.light.4.raw
catagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 540616 - DNA, 492 bp, Homo sapiens; identical to SEQ ID NO: 536175
  misc_feature: HIJSMM301BTZ71.19.83.H06.1.454.light.4.raw

SEQ ID NO: 540617 - DNA, 504 bp, Homo sapiens
  misc_feature: HIJSMM301D15WS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaatacaaacgaactagtggctgcaccatctgtcttctatcttccccg

SEQ ID NO: 540618 - DNA, 496 bp, Homo sapiens; identical to SEQ ID NO: 537513
  misc_feature: HIJSMM301AZ7WH.12.87.H10.1.454.light.4.raw

SEQ ID NO: 540619 - DNA, 497 bp, Homo sapiens
  misc_feature: HIJSMM301C849V.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaccccgatcaccttcggccgagggacacgcctggagattaaacgaactgtggctgcaccat

SEQ ID NO: 540620 - DNA, 494 bp, Homo sapiens
  misc_feature: HIJSMM301D4V21.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatcggggtatgctgcatccaccagggccactggtatcccagccaggttcagtggcagtgggtctgggacagagttcattctcaccatcagcagcctgcagtctgaagatttgcaatttattactgtcagcagtataataactggtggacgttcggtccaagggaccaaggtagaaatacaaacgaactagtggctgcaccatctgtt

SEQ ID NO: 540621 - DNA, 487 bp, Homo sapiens
  misc_feature: HIJSMM301ERE8G.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaaggctggagatcaaacgaactgtggctgcaccat

SEQ ID NO: 540622 - DNA, 503 bp, Homo sapiens; identical to SEQ ID NO: 535044
  misc_feature: HIJSMM301B3JG7.19.78.H01.1.454.light.4.raw

SEQ ID NO: 540623 - DNA, 491 bp, Homo sapiens
  misc_feature: HIJSMM301DHBN6.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaaggctggagatcaaacgaactgt

SEQ ID NO: 540624 - DNA, 489 bp, Homo sapiens; identical to SEQ ID NO: 535139
  misc_feature: HIJSMM301CBSTW.14.55.E11.1.454.light.4.raw

SEQ ID NO: 540625 - DNA, 486 bp, Homo sapiens; identical to SEQ ID NO: 535385
  misc_feature: HIJSMM301D8WUA.19.71.G05.1.454.light.4.raw

SEQ ID NO: 540626 - DNA, 486 bp, Homo sapiens
  misc_feature: HIJSMM301BK0MZ.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgcccccg

SEQ ID NO: 540627 - DNA, 503 bp, Homo sapiens
  misc_feature: HIJSMM301BV9LC.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggcctccggctcgtgggactgagcgctacctcaccatcctccagccctccagtctggaggacggagggtgacttattactgtcagacggtgggacacgtggctagtttgggtgttcgggcggagggaccaaggttcgaccgtccgtaggtcacgcccaaggctcccg

SEQ ID NO: 540628 - DNA, 496 bp, Homo sapiens; identical to SEQ ID NO: 540287
  misc_feature: HIJSMM301ED9EV.40.11.A11.1.454.light.4.raw

SEQ ID NO: 540629 - DNA, 491 bp, Homo sapiens; identical to SEQ ID NO: 538238
  misc_feature: HIJSMM301DNCXX.26.78.H01.1.454.light.4.raw

SEQ ID NO: 540630 - DNA, 511 bp, Homo sapiens
  misc_feature: HIJSMM301EEMEA.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaacccactgtcactcc

SEQ ID NO: 540631 - DNA, 500 bp, Homo sapiens
  misc_feature: HIJSMM301BJZCH.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttccccgccctcctcactactcaca

SEQ ID NO: 540632 - DNA, 460 bp, Homo sapiens; identical to SEQ ID NO: 537107
  misc_feature: HIJSMM301C8O7O.22.28.C06.1.454.light.4.raw

SEQ ID NO: 540633 - DNA, 488 bp, Homo sapiens; identical to SEQ ID NO: 535725
  misc_feature: HIJSMM301AUQXH.12.88.H11.1.454.light.4.raw

SEQ ID NO: 540634 - DNA, 495 bp, Homo sapiens; identical to SEQ ID NO: 535486
  misc_feature: HIJSMM301D560C.26.72.G06.1.454.light.4.raw

SEQ ID NO: 540635 - DNA, 489 bp, Homo sapiens
  misc_feature: HIJSMM301CDFR9.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctccga

SEQ ID NO: 540636 - DNA, 504 bp, Homo sapiens
  misc_feature: HIJSMM301DMHZD.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggaccagggtggaaatcagacgaactgtggctgcaccatctgtctt

SEQ ID NO: 540637 - DNA, 509 bp, Homo sapiens
  misc_feature: HIJSMM301B0TQH.48.73.G07.1.454.light.4.raw
agtatacatacacgaccggtgctcgatttagctctacgctcaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccacctcct

SEQ ID NO: 540638 - DNA, 472 bp, Homo sapiens
  misc_feature: HIJSMM301A0MUE.8.67.G01.1.454.light.4.raw
ctcgcgtgtccacgaccggtgctcgatttagagtatacatattgggtttgggggctttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 540639 - DNA, 485 bp, Homo sapiens
  misc_feature: HIJSMM301CA3C8.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatcaccttcggccaagggacacgactggagatgaaacgaactgtggctgcacca

SEQ ID NO: 540640 - DNA, 508 bp, Homo sapiens
  misc_feature: HIJSMM301AUBBU.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgcccccc

SEQ ID NO: 540641 - DNA, 496 bp, Homo sapiens
  misc_feature: HIJSMM301BA0BM.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcgggggaccaaactgaccgtcctaggtcagccaaggctgcccctcggt

SEQ ID NO: 540642 - DNA, 447 bp, Homo sapiens; identical to SEQ ID NO: 535201
  misc_feature: HIJSMM301C1MCV.18.9.A09.1.454.light.4.raw

SEQ ID NO: 540643 - DNA, 495 bp, Homo sapiens; identical to SEQ ID NO: 539809
  misc_feature: HIJSMM301B86H1.3.33.C11.1.454.light.4.raw

SEQ ID NO: 540644 - DNA, 496 bp, Homo sapiens; identical to SEQ ID NO: 535224
  misc_feature: HIJSMM301D31DY.22.57.F02.1.454.light.4.raw

SEQ ID NO: 540645 - DNA, 494 bp, Homo sapiens
  misc_feature: HIJSMM301DDSMF.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 540646 - DNA, 491 bp, Homo sapiens
  misc_feature: HIJSMM301CPXV2.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggcggagatcagacgaactgtggctgcaccatctgtcttcta

SEQ ID NO: 540647 - DNA, 463 bp, Homo sapiens; identical to SEQ ID NO: 535008
  misc_feature: HIJSMM301ASHKS.10.9.A09.1.454.light.4.raw

SEQ ID NO: 540648 - DNA, 494 bp, Homo sapiens
  misc_feature: HIJSMM301C2OJM.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagttattactgtcagcaatattatagtactcctccgaggctcactttcggcgagggaccaaggtggagatcaaacgaactgt

SEQ ID NO: 540649 - DNA, 488 bp, Homo sapiens; identical to SEQ ID NO: 537124
  misc_feature: HIJSMM301AYN17.11.25.C03.1.454.light.4.raw

SEQ ID NO: 540650 - DNA, 484 bp, Homo sapiens; identical to SEQ ID NO: 535240
  misc_feature: HIJSMM301ADTWI.47.60.F05.1.454.light.4.raw

SEQ ID NO: 540651 - DNA, 483 bp, Homo sapiens
  misc_feature: HIJSMM301BIGV2.49.12.B01.1.454.light.4.raw
agtcgagagacacgaccggtgctcgatttagtagtgtagattccgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcacc

SEQ ID NO: 540652 - DNA, 470 bp, Homo sapiens
  misc_feature: HIJSMM301ECF1R.49.8.A08.1.454.light.4.raw
agtcgagagacacgaccggtgctcgatttagcatactctacagggggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcaggctgcagcctgaagatattgcaacatattactgtcaacagtatgatcgtctcccgctcactttcggcggggggaccgaaggtggagatcaagcgaactgtggctg

SEQ ID NO: 540653 - DNA, 487 bp, Homo sapiens; identical to SEQ ID NO: 537220
  misc_feature: HIJSMM301C1CGE.16.53.E09.1.454.light.4.raw

SEQ ID NO: 540654 - DNA, 495 bp, Homo sapiens
  misc_feature: HIJSMM301CK0LA.48.56.F01.1.454.light.4.raw
agtatacatacacgaccggtgctcgatttagcagacgtctgaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaaacgaactgtggctgcaccatctgt

SEQ ID NO: 540655 - DNA, 489 bp, Homo sapiens
  misc_feature: HIJSMM301AWMRZ.22.87.H10.1.454.light.4.raw
acatacgcgtcacgaccggtgctcgatttagcagtactgcgttgggtttgggggcttcagctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagcccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctgggtgccgtggtattcggcggagggaccaagctgaccgtccta

SEQ ID NO: 540656 - DNA, 489 bp, Homo sapiens; identical to SEQ ID NO: 536663
  misc_feature: HIJSMM301BOL47.16.72.G06.1.454.light.4.raw

SEQ ID NO: 540657 - DNA, 485 bp, Homo sapiens
  misc_feature: HIJSMM301A5TGG.43.36.D03.1.454.light.4.raw
  modified_base (440)..(440): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagngctccgtacacttttggccaggggaccaagttggagatcaaacga

SEQ ID NO: 540658 - DNA, 482 bp, Homo sapiens
  misc_feature: HIJSMM301ANRP9.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatctgt

SEQ ID NO: 540659 - DNA, 383 bp, Homo sapiens; identical to SEQ ID NO: 447524
  misc_feature: HIJSMM301A42HK.41.26.C04.1.454.light.4.raw

SEQ ID NO: 540660 - DNA, 484 bp, Homo sapiens
  misc_feature: HIJSMM301BIR6T.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattatgtcaacaatattattatacttcgtggacgttcggccaagggaccaaggtggatatcagagaa

SEQ ID NO: 540661 - DNA, 484 bp, Homo sapiens; identical to SEQ ID NO: 535400
  misc_feature: HIJSMM301D3KP8.46.26.C04.1.454.light.4.raw

SEQ ID NO: 540662 - DNA, 485 bp, Homo sapiens; identical to SEQ ID NO: 535822
  misc_feature: HIJSMM301B56VI.14.53.E09.1.454.light.4.raw

SEQ ID NO: 540663 - DNA, 487 bp, Homo sapiens
  misc_feature: HIJSMM301C5GVX.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagttggataatcaaacgaactgtggctgcaccatctgtt

SEQ ID NO: 540664 - DNA, 494 bp, Homo sapiens
  misc_feature: HIJSMM301A6B9G.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactgtggctgcaccatctgtcttcatt

SEQ ID NO: 540665 - DNA, 503 bp, Homo sapiens
  misc_feature: HIJSMM301CRJES.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctcgtcctacgtcagcccaaggccaactccactgtcact

SEQ ID NO: 540666 - DNA, 484 bp, Homo sapiens; identical to SEQ ID NO: 535211
  misc_feature: HIJSMM301C3WD0.47.46.E02.1.454.light.4.raw

SEQ ID NO: 540667 - DNA, 461 bp, Homo sapiens
  misc_feature: HIJSMM301C2671.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcgcgggggaccgaaggtggagatccagcgaa

SEQ ID NO: 540668 - DNA, 447 bp, Homo sapiens; identical to SEQ ID NO: 535020
  misc_feature: HIJSMM301DEMHN.18.9.A09.1.454.light.4.raw

SEQ ID NO: 540669 - DNA, 384 bp, Homo sapiens
  misc_feature: HIJSMM301DC5NY.41.26.C04.1.454.light.4.raw
tctatactatcacgaccggtgctcgatttagtctagcgactttgggtttggggaagagccaccctcctcctgcagggccgagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtataga

SEQ ID NO: 540670 - DNA, 497 bp, Homo sapiens
  misc_feature: HIJSMM301ADA05.16.6.A06.1.454.light.4.raw
tgtactactccacgaccggtgctcgatttagatctactgacagggggaggctacaacaggcaggcgaggggcgagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatcaaacgaactgtggctgcaccat

SEQ ID NO: 540671 - DNA, 447 bp, Homo sapiens; identical to SEQ ID NO: 535882
  misc_feature: HIJSMM301DBDKF.18.9.A09.1.454.light.4.raw
  modified_base (429)..(429): a, c, t, g, unknown or other

SEQ ID NO: 540672 - DNA, 502 bp, Homo sapiens
  misc_feature: HIJSMM301CZ4ZB.40.17.B06.1.454.light.4.raw
tctagcgactcacgaccggtgctcgatttagtcgatagtgaagggggagtcagacccacgtcaggacacagcatggacatgagggtccccgcctcagctcctggggcgtcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggtccaagggaccaaggtagaaatcaaacgaactgtggctgcaccatctgtcttcatcttcccgccca

SEQ ID NO: 540673 - DNA, 485 bp, Homo sapiens
  misc_feature: HIJSMM301DR90M.48.42.D09.1.454.light.4.raw
agtatacatacacgaccggtgctcgatttagacacatacgcagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcgcgggaccaaggtggagatcaaacgaactgtggctgcacc

SEQ ID NO: 540674 - DNA, 447 bp, Homo sapiens; identical to SEQ ID NO: 535201
  misc_feature: HIJSMM301DCE20.18.9.A09.1.454.light.4.raw

SEQ ID NO: 540675 - DNA, 497 bp, Homo sapiens
  misc_feature: HIJSMM301AY1XX.48.59.F04.1.454.light.4.raw
agtatacatacacgaccggtgctcgatttagtacacacacttagggattgggggctctggagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccat

SEQ ID NO: 540676 - DNA, 520 bp, Homo sapiens; identical to SEQ ID NO: 538570
  misc_feature: HIJSMM301BTSER.27.23.C01.1.454.light.4.raw

SEQ ID NO: 540677 - DNA, 504 bp, Homo sapiens
  misc_feature: HIJSMM301DXBG5.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctggt

SEQ ID NO: 540678 - DNA, 510 bp, Homo sapiens; identical to SEQ ID NO: 538614
  misc_feature: HIJSMM301BVN4U.19.59.F04.1.454.light.4.raw

SEQ ID NO: 540679 - DNA, 489 bp, Homo sapiens; identical to SEQ ID NO: 535139
  misc_feature: HIJSMM301D58KU.14.55.E11.1.454.light.4.raw

SEQ ID NO: 540680 - DNA, 465 bp, Homo sapiens
  misc_feature: HIJSMM301DL0EP.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 540681 - DNA, 504 bp, Homo sapiens
  misc_feature: HIJSMM301DTIQR.43.24.C02.1.454.light.4.raw
tgtgagtagtcacgaccggtgctcgatttagtacagatcgttagggaaaggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggttattataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattattgcagttcatatacaagcagcaccactattatgtcttcggagctgggaccaaggtcaccgtcctaggtcagcccaaggccaacccca

SEQ ID NO: 540682 - DNA, 488 bp, Homo sapiens
  misc_feature: HIJSMM301BNTEY.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacggaccgaacggtggaaagtacaaacgaactagtggctgcacca

SEQ ID NO: 540683 - DNA, 480 bp, Homo sapiens
  misc_feature: HIJSMM301AVET1.41.5.A05.1.454.light.4.raw
tctatactatcacgaccggtgctcgatttagatagatagacagggggcaggagtcagacccagtcaggacacagcatggacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcacca

SEQ ID NO: 540684 - DNA, 504 bp, Homo sapiens
  misc_feature: HIJSMM301BFFEO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtgagatcaaacgaactgtggctgcaccatctgtcttcatcttcccgccat

SEQ ID NO: 540685 - DNA, 485 bp, Homo sapiens
  misc_feature: HIJSMM301BKXVC.4.36.D03.1.454.light.4.raw
agcactgtagcacgaccggtgctcgatttagctgcgtcacgatctctcttggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctccggtttggaaagtggggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactagtggctgcaccat

SEQ ID NO: 540686 - DNA, 489 bp, Homo sapiens
  misc_feature: HIJSMM301DL8Z9.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagatcaaacgaaa

SEQ ID NO: 540687 - DNA, 486 bp, Homo sapiens
  misc_feature: HIJSMM301BG16N.26.37.D04.1.454.light.4.raw
agactatactcacgaccggtgctcgatttagtagcatactgttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccat

SEQ ID NO: 540688 - DNA, 494 bp, Homo sapiens; identical to SEQ ID NO: 534994
  misc_feature: HIJSMM301B708E.27.78.H01.1.454.light.4.raw

SEQ ID NO: 540689 - DNA, 504 bp, Homo sapiens
  misc_feature: HIJSMM301D5NF6.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccccg

SEQ ID NO: 540690 - DNA, 495 bp, Homo sapiens
  misc_feature: HIJSMM301A5DRS.7.59.F04.1.454.light.4.raw
cgtgtctctacacgaccggtgctcgatttagtacacacacttagggattggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaaggaccagggtgggaaatacaaacgaactgtggctgcaccatctgtcttcatt

SEQ ID NO: 540691 - DNA, 444 bp, Homo sapiens; identical to SEQ ID NO: 535192
  misc_feature: HIJSMM301CP7VW.5.9.A09.1.454.light.4.raw

SEQ ID NO: 540692 - DNA, 506 bp, Homo sapiens
  misc_feature: HIJSMM301CO5BY.43.34.D01.1.454.light.4.raw
tgtgagtagtcacgaccggtgctcgatttagatcgtctgtgttgaggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacgacggcctccctgacaatctctgggctccaggctgaggacgaggctgattattattgctgctcatatgcagggtagttacacttatgttcttcggaattgggacgacggtcaccgttcctaggtcagccccaaggcccaaaccccactgtccactctgttcccaccctcctcactactca

SEQ ID NO: 540693 - DNA, 493 bp, Homo sapiens
  misc_feature: HIJSMM301COO6Y.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatccaccttcggccaagggacacgactggagattaaacgaactgtggctgcaccatctgtcttcatt

SEQ ID NO: 540694 - DNA, 503 bp, Homo sapiens
  misc_feature: HIJSMM301CTG06.47.55.E11.1.454.light.4.raw
agctcacgtacacgaccggtgctcgatttagcactcgcacgtagggtcttgggcccagtctgtgctgactcagccaccctcagcgtctgggacccccggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccccactgtcactctgttcccaccctcctcta

SEQ ID NO: 540695 - DNA, 439 bp, Homo sapiens
  misc_feature: HIJSMM301BMJRH.41.9.A09.1.454.light.4.raw
tctatactatcacgaccggtgctcgatttagcgagacgcgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctgttcccaccctcctcatagtataga

SEQ ID NO: 540696 - DNA, 454 bp, Homo sapiens
  misc_feature: HIJSMM301COPN1.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagactggaggctgattattactgtgcaatctgggatgacagtgtgaacggtccggttttcggcggagggaccaagctgaccgtcctaagtcagcccaaggctgcccctcggtcactctgttcccgcctcctccacgagagta

SEQ ID NO: 540697 - DNA, 488 bp, Homo sapiens; identical to SEQ ID NO: 535861
  misc_feature: HIJSMM301BPKO1.14.55.E11.1.454.light.4.raw

SEQ ID NO: 540698 - DNA, 383 bp, Homo sapiens
  misc_feature: HIJSMM301EQ5QR.41.28.C06.1.454.light.4.raw
tctatactatcacgaccggtgctcgatttagagctcacgtattgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 540699 - DNA, 454 bp, Homo sapiens; identical to SEQ ID NO: 535005
  misc_feature: HIJSMM301BNIBN.19.86.H09.1.454.light.4.raw

SEQ ID NO: 540700 - DNA, 488 bp, Homo sapiens
  misc_feature: HIJSMM301AXAGT.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtgaaatcaaacgaactagtggctgcaccat

SEQ ID NO: 540701 - DNA, 487 bp, Homo sapiens; identical to SEQ ID NO: 536536
  misc_feature: HIJSMM301A7D0N.26.45.E01.1.454.light.4.raw

SEQ ID NO: 540702 - DNA, 481 bp, Homo sapiens
  misc_feature: HIJSMM301BZBME.13.8.A08.1.454.light.4.raw
tcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgt

SEQ ID NO: 540703 - DNA, 485 bp, Homo sapiens; identical to SEQ ID NO: 536040
  misc_feature: HIJSMM301C8825.15.1.A01.1.454.light.4.raw

SEQ ID NO: 540704 - DNA, 504 bp, Homo sapiens; identical to SEQ ID NO: 536235
  misc_feature: HIJSMM301DWA2Q.2.71.G05.1.454.light.4.raw

SEQ ID NO: 540705 - DNA, 498 bp, Homo sapiens
  misc_feature: HIJSMM301DDX3Z.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacccgtcctaggtcagcccaagg

SEQ ID NO: 540706 - DNA, 495 bp, Homo sapiens; identical to SEQ ID NO: 535596
  misc_feature: HIJSMM301C51MI.10.79.H02.1.454.light.4.raw

SEQ ID NO: 540707 - DNA, 444 bp, Homo sapiens; identical to SEQ ID NO: 535192
  misc_feature: HIJSMM301AHKU1.5.9.A09.1.454.light.4.raw

SEQ ID NO: 540708 - DNA, 489 bp, Homo sapiens
  misc_feature: HIJSMM301AQWW3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgaa

SEQ ID NO: 540709 - DNA, 453 bp, Homo sapiens
  misc_feature: HIJSMM301D3FLK.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcgcggagggaccaagctgaccgtcctaagtcagcccaaggctgccccctccggtcactctgttcccaccctcctccacgagagta

SEQ ID NO: 540710 - DNA, 444 bp, Homo sapiens; identical to SEQ ID NO: 534993
  misc_feature: HIJSMM301C0BV3.5.9.A09.1.454.light.4.raw

SEQ ID NO: 540711 - DNA, 497 bp, Homo sapiens; identical to SEQ ID NO: 535740
  misc_feature: HIJSMM301BCC13.3.71.G05.1.454.light.4.raw

SEQ ID NO: 540712 - DNA, 506 bp, Homo sapiens
  misc_feature: HIJSMM301EMWVU.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaaacttcggggtgttcgggcggagggaccaagctgaccgtcctaggtcaagccccg

SEQ ID NO: 540713 - DNA, 441 bp, Homo sapiens; identical to SEQ ID NO: 534971
  misc_feature: HIJSMM301BDKJD.11.3.A03.1.454.light.4.raw

SEQ ID NO: 540714 - DNA, 516 bp, Homo sapiens
  misc_feature: HIJSMM301AJWQ8.51.43.D10.1.454.light.4.raw
cgatcgtatacacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaaggccaaccccactgtcactctgttcccgccctcctctcgta

SEQ ID NO: 540715 - DNA, 513 bp, Homo sapiens
  misc_feature: HIJSMM301ATGTH.48.77.G11.1.454.light.4.raw
agtatacatacacgaccggtgctcgatttagctagtcactcaagggaaaggggagtctgggcctaaggaagcagcactggtggtgcttcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccg

SEQ ID NO: 540716 - DNA, 497 bp, Homo sapiens; identical to SEQ ID NO: 535286
  misc_feature: HIJSMM301B1MC4.18.59.F04.1.454.light.4.raw

SEQ ID NO: 540717 - DNA, 493 bp, Homo sapiens
  misc_feature: HIJSMM301AJYA1.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgtatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcatt

SEQ ID NO: 540718 - DNA, 508 bp, Homo sapiens
  misc_feature: HIJSMM301CJSZ1.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatggttggggtttattactgcatgcaaactacacacggccgctcactttcggcggagggaccaaggtggagatacaaacgaactgtggctgcaccatctgtt

SEQ ID NO: 540719 - DNA, 515 bp, Homo sapiens
  misc_feature: HIJSMM301DJHZI.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttccc

SEQ ID NO: 540720 - DNA, 504 bp, Homo sapiens; identical to SEQ ID NO: 538940
  misc_feature: HIJSMM301BY803.2.35.D02.1.454.light.4.raw

SEQ ID NO: 540721 - DNA, 520 bp, Homo sapiens
  misc_feature: HIJSMM301B1CTT.41.53.E09.1.454.light.4.raw
tctatactatcacgaccggtgctcgatttagagagagtgtgttgggtttgggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttccca

SEQ ID NO: 540722 - DNA, 494 bp, Homo sapiens; identical to SEQ ID NO: 535478
  misc_feature: HIJSMM301BXCMC.10.79.H02.1.454.light.4.raw

SEQ ID NO: 540723 - DNA, 494 bp, Homo sapiens; identical to SEQ ID NO: 534992
  misc_feature: HIJSMM301BHEFQ.9.1.A01.1.454.light.4.raw

SEQ ID NO: 540724 - DNA, 493 bp, Homo sapiens; identical to SEQ ID NO: 538753
  misc_feature: HIJSMM301CQWL2.27.78.H01.1.454.light.4.raw

SEQ ID NO: 540725 - DNA, 517 bp, Homo sapiens
  misc_feature: HIJSMM301AX8R7.49.10.A10.1.454.light.4.raw
agtcgagagacacgaccggtgctcgatttagcgtcgatctcaggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctct

SEQ ID NO: 540726 - DNA, 512 bp, Homo sapiens
  misc_feature: HIJSMM301DQ1Q2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccgaaggtgggaaaagtacaaacgaaactagtggcgtgcaccatctgtcttcatcttccccg

SEQ ID NO: 540727 - DNA, 492 bp, Homo sapiens
  misc_feature: HIJSMM301C04YH.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactagtggctgcaccatctgtcttcta

SEQ ID NO: 540728 - DNA, 492 bp, Homo sapiens; identical to SEQ ID NO: 537395
  misc_feature: HIJSMM301BMFHN.16.73.G07.1.454.light.4.raw

SEQ ID NO: 540729 - DNA, 501 bp, Homo sapiens; identical to SEQ ID NO: 536867
  misc_feature: HIJSMM301BDKAF.5.86.H09.1.454.light.4.raw

SEQ ID NO: 540730 - DNA, 447 bp, Homo sapiens; identical to SEQ ID NO: 535020
  misc_feature: HIJSMM301DBLUD.18.9.A09.1.454.light.4.raw

SEQ ID NO: 540731 - DNA, 483 bp, Homo sapiens
  misc_feature: HIJSMM301CISQ1.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaaagctggagatcaggcgaactgtggctgca

SEQ ID NO: 540732 - DNA, 497 bp, Homo sapiens
  misc_feature: HIJSMM301CJQV2.16.78.H01.1.454.light.4.raw
tgtactactccacgaccggtgctcgatttagtgtgagtagtttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgtcggtttattactgtcagcagtataataactggcctccacggtacacttttggccaggggaccaagctggagatcaaacgaactgtggctgcaccatctgtt

SEQ ID NO: 540733 - DNA, 475 bp, Homo sapiens
  misc_feature: HIJSMM301DLWMF.51.40.D07.1.454.light.4.raw
cgatcgtatacacgaccggtgctcgatttagtgatagagcgtaacaacagagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaa

SEQ ID NO: 540734 - DNA, 471 bp, Homo sapiens
  misc_feature: HIJSMM301CRCG6.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttggccctgggactgaatgcataatgaagagaactgtgg

SEQ ID NO: 540735 - DNA, 493 bp, Homo sapiens
  misc_feature: HIJSMM301DXJ6X.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattactgtcagcagcgtgagttctggcctccgctcactttcggcggagggaccagggtggagatcaaacgaactgtggctgcacatctgtcttcatt

SEQ ID NO: 540736 - DNA, 515 bp, Homo sapiens
  misc_feature: HIJSMM301AT7HW.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggtttttattcactttcggtccccgtcgggtaccgaaaacgtagggagttttacctagacggaaacctggtgggctgcaccaatctgttcttcta

SEQ ID NO: 540737 - DNA, 508 bp, Homo sapiens
  misc_feature: HIJSMM301BHH7O.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgt

SEQ ID NO: 540738 - DNA, 483 bp, Homo sapiens
  misc_feature: HIJSMM301AD35S.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 540739 - DNA, 508 bp, Homo sapiens
  misc_feature: HIJSMM301AEDUD.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagccc

SEQ ID NO: 540740 - DNA, 463 bp, Homo sapiens
  misc_feature: HIJSMM301EVPZG.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatcaagcgaa

SEQ ID NO: 540741 - DNA, 490 bp, Homo sapiens
  misc_feature: HIJSMM301CWYNA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggaggatcagacgaactgtggctgcaccatctgtcttcta

SEQ ID NO: 540742 - DNA, 498 bp, Homo sapiens
  misc_feature: HIJSMM301AYAUF.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 540743 - DNA, 513 bp, Homo sapiens
  misc_feature: HIJSMM301C3WS9.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcgtccaagggaccgaaggtggaaggtacgaaacgaactacgtggctgcaccatctgtcttctatcttcccgcccact

SEQ ID NO: 540744 - DNA, 507 bp, Homo sapiens; identical to SEQ ID NO: 535930
  misc_feature: HIJSMM301DYIBK.15.34.D01.1.454.light.4.raw

SEQ ID NO: 540745 - DNA, 504 bp, Homo sapiens
  misc_feature: HIJSMM301DYU1Y.47.83.H06.1.454.light.4.raw
agctcacgtacacgaccggtgctcgatttagatcacgtgcgtcgcggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggccccaggcagatgatgagtgtgattattactgtgtgctctatatgggcagtggcgtttgggtgttcggcggagggaccaagctgaccgtcg

SEQ ID NO: 540746 - DNA, 484 bp, Homo sapiens; identical to SEQ ID NO: 535240
  misc_feature: HIJSMM301AH46S.47.60.F05.1.454.light.4.raw

SEQ ID NO: 540747 - DNA, 484 bp, Homo sapiens
  misc_feature: HIJSMM301CIA8G.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcggcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtctt

SEQ ID NO: 540748 - DNA, 506 bp, Homo sapiens
  misc_feature: HIJSMM301BD1RR.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggaggatcaaacgaactgtggctgcaccatctgt

SEQ ID NO: 540749 - DNA, 510 bp, Homo sapiens; identical to SEQ ID NO: 538614
  misc_feature: HIJSMM301C5NPK.19.59.F04.1.454.light.4.raw

SEQ ID NO: 540750 - DNA, 485 bp, Homo sapiens; identical to SEQ ID NO: 539576
  misc_feature: HIJSMM301BKLB4.4.57.F02.1.454.light.4.raw

SEQ ID NO: 540751 - DNA, 486 bp, Homo sapiens
  misc_feature: HIJSMM301D26P0.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccgaagctgaccgtcctaggtcagcccaacggctgccccctccggtc

SEQ ID NO: 540752 - DNA, 488 bp, Homo sapiens; identical to SEQ ID NO: 535861
  misc_feature: HIJSMM301EF3C2.14.55.E11.1.454.light.4.raw

SEQ ID NO: 540753 - DNA, 495 bp, Homo sapiens; identical to SEQ ID NO: 537415
  misc_feature: HIJSMM301CCRB4.4.27.C05.1.454.light.4.raw

SEQ ID NO: 540754 - DNA, 486 bp, Homo sapiens
  misc_feature: HIJSMM301BU4B6.22.73.G07.1.454.light.4.raw
acatacgcgtcacgaccggtgctcgatttagctctacgctcagggggaggaactgctcagttaggacccagacggaaccatggaagccccagcgcagcctctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgt

SEQ ID NO: 540755 - DNA, 484 bp, Homo sapiens; identical to SEQ ID NO: 535400
  misc_feature: HIJSMM301BLY1O.46.26.C04.1.454.light.4.raw

SEQ ID NO: 540756 - DNA, 348 bp, Homo sapiens
  misc_feature: HIJSMM301CXZJN.13.11.A11.1.454.light.4.raw
tcacgtactacacgaccggtgctcgatttagctacgactgcagggccagtcagattgtcagcagcaactacttagcctggtaccagcagaagcctggccaggccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgccatctgatagtacgtga

SEQ ID NO: 540757 - DNA, 494 bp, Homo sapiens; identical to SEQ ID NO: 534994
  misc_feature: HIJSMM301A73UJ.27.78.H01.1.454.light.4.raw

SEQ ID NO: 540758 - DNA, 492 bp, Homo sapiens
  misc_feature: HIJSMM301AMPTF.26.26.C04.1.454.light.4.raw
  modified_base (480)..(480): a, c, t, g, unknown or other
  modified_base (487)..(487): a, c, t, g, unknown or other
agactatactcacgaccggtgctcgatttagtctagcgactttgggtttgggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggagtcgcaaggacgagtggaagtacaacgaactntggctgnaccat

SEQ ID NO: 540759 - DNA, 485 bp, Homo sapiens
  misc_feature: HIJSMM301DPLKK.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtgagatcaaacgaa

SEQ ID NO: 540760 - DNA, 492 bp, Homo sapiens
  misc_feature: HIJSMM301AEFGH.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcactttcggcggacgggaccaaggcggagatcagacgaactgtggctgcaccatctgtcttcta

SEQ ID NO: 540761 - DNA, 447 bp, Homo sapiens; identical to SEQ ID NO: 535201
  misc_feature: HIJSMM301CP8CL.18.9.A09.1.454.light.4.raw

SEQ ID NO: 540762 - DNA, 447 bp, Homo sapiens; identical to SEQ ID NO: 535201
  misc_feature: HIJSMM301A6T5A.18.9.A09.1.454.light.4.raw

SEQ ID NO: 540763 - DNA, 501 bp, Homo sapiens; identical to SEQ ID NO: 536142
  misc_feature: HIJSMM301B7KB1.15.1.A01.1.454.light.4.raw

SEQ ID NO: 540764 - DNA, 447 bp, Homo sapiens; identical to SEQ ID NO: 535201
  misc_feature: HIJSMM301ATJXM.18.9.A09.1.454.light.4.raw

SEQ ID NO: 540765 - DNA, 503 bp, Homo sapiens
  misc_feature: HIJSMM301DA5JU.16.49.E05.1.454.light.4.raw
tgtactactccacgaccggtgctcgatttagagcgactagcaacacacaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgccccccg

SEQ ID NO: 540766 - DNA, 516 bp, Homo sapiens
  misc_feature: HIJSMM301EX2NI.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctcgttcccgccctcctcg

SEQ ID NO: 540767 - DNA, 494 bp, Homo sapiens
  misc_feature: HIJSMM301BC091.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggccaggggaccaagctagaaatcaaacgaactgtggctgcaccatctgtcttcta

SEQ ID NO: 540768 - DNA, 495 bp, Homo sapiens
  misc_feature: HIJSMM301BOIVW.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactgtggcgtgcaccatctgtt

SEQ ID NO: 540769 - DNA, 432 bp, Homo sapiens
  misc_feature: HIJSMM301A1J11.18.59.F04.1.454.light.4.raw
tacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccccactgtcactctgttcccaccctcctccatactcgta

SEQ ID NO: 540770 - DNA, 354 bp, Homo sapiens; identical to SEQ ID NO: 535026
  misc_feature: HIJSMM301BJWE0.19.22.B11.1.454.light.4.raw

SEQ ID NO: 540771 - DNA, 491 bp, Homo sapiens
  misc_feature: HIJSMM301AZNX8.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaggtggaggtcaacgaactgtggctgcaccatctgtcttcta

SEQ ID NO: 540772 - DNA, 505 bp, Homo sapiens
  misc_feature: HIJSMM301CL418.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgccccccg

SEQ ID NO: 540773 - DNA, 507 bp, Homo sapiens
  misc_feature: HIJSMM301DBS8O.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccc

SEQ ID NO: 540774 - DNA, 497 bp, Homo sapiens
  misc_feature: HIJSMM301EJDO9.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtggacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaaactgtggctgcaccatctgtcttcat

SEQ ID NO: 540775 - DNA, 490 bp, Homo sapiens
  misc_feature: HIJSMM301EZYYR.52.23.C01.1.454.light.4.raw
  modified_base (482)..(482): a, c, t, g, unknown or other
cgcagtacgacacgaccggtgctcgatttagtacacgtgattagggattgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagatttgtcaacatattactgtcaacaatatgaagatctccccctccactttcgcggagggaccgaacggtaggagatcagacgaactgtgngtgcacca

SEQ ID NO: 540776 - DNA, 505 bp, Homo sapiens
  misc_feature: HIJSMM301C6YWY.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtcctaggtcagcccaaggccaacccactgt

SEQ ID NO: 540777 - DNA, 485 bp, Homo sapiens; identical to SEQ ID NO: 536040
  misc_feature: HIJSMM301CLVSO.15.1.A01.1.454.light.4.raw

SEQ ID NO: 540778 - DNA, 508 bp, Homo sapiens
  misc_feature: HIJSMM301CJZSB.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaagtacaaacgaacctagtggctgcaccatctgtcttcatcttccccg

SEQ ID NO: 540779 - DNA, 495 bp, Homo sapiens; identical to SEQ ID NO: 535821
  misc_feature: HIJSMM301A9H76.3.31.C09.1.454.light.4.raw

SEQ ID NO: 540780 - DNA, 489 bp, Homo sapiens; identical to SEQ ID NO: 535091
  misc_feature: HIJSMM301EF518.47.36.D03.1.454.light.4.raw

SEQ ID NO: 540781 - DNA, 354 bp, Homo sapiens; identical to SEQ ID NO: 540485
  misc_feature: HIJSMM301DGIN3.40.9.A09.1.454.light.4.raw

SEQ ID NO: 540782 - DNA, 419 bp, Homo sapiens
  misc_feature: HIJSMM301AZIDH.18.78.H01.1.454.light.4.raw
tacgagtatgcacgaccggtgctcgatttagtgtgagtagtttgggtttgggggctttgtctgggtcgtcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggcctccaagtctggcaacacggcctccctgaccatctctgggctccgggctgaggacgaggctgattattactgcagctcatactacaagcagcagcactcaagtcttcggaactgggaccaaggtcaccgtcctaggtcagcccaaggccaacccctctgtcactctgttcccaccctcctccatactcgta

SEQ ID NO: 540783 - DNA, 492 bp, Homo sapiens
  misc_feature: HIJSMM301DZOHH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagataaaggaactgtggctgcaccatctgtcttcatcttcccg

SEQ ID NO: 540784 - DNA, 510 bp, Homo sapiens; identical to SEQ ID NO: 535855
  misc_feature: HIJSMM301APMLN.17.33.C11.1.454.light.4.raw

SEQ ID NO: 540785 - DNA, 447 bp, Homo sapiens; identical to SEQ ID NO: 535020
  misc_feature: HIJSMM301AOY78.18.9.A09.1.454.light.4.raw

SEQ ID NO: 540786 - DNA, 447 bp, Homo sapiens; identical to SEQ ID NO: 535201
  misc_feature: HIJSMM301A3252.18.9.A09.1.454.light.4.raw

SEQ ID NO: 540787 - DNA, 501 bp, Homo sapiens
  misc_feature: HIJSMM301BKSLK.10.44.D11.1.454.light.4.raw
catagtagtgcacgaccggtgctcgatttagcgcagtacgaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcat

SEQ ID NO: 540788 - DNA, 490 bp, Homo sapiens
  misc_feature: HIJSMM301ATJUA.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccgagggtactttcggccctgggacgtaaggtggaggatcagacgaactgtggctgcaccatctgttcttcta

SEQ ID NO: 540789 - DNA, 497 bp, Homo sapiens
  misc_feature: HIJSMM301AVOW2.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcatt

SEQ ID NO: 540790 - DNA, 486 bp, Homo sapiens
  misc_feature: HIJSMM301B1VYZ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttcggatctgggaccagggtcaccgtctaggtcagcccaaggccaaccca

SEQ ID NO: 540791 - DNA, 490 bp, Homo sapiens
  misc_feature: HIJSMM301BBINJ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccggggaccaagctggagatcaaacgaactgtggctgcaccatctgtt

SEQ ID NO: 540792 - DNA, 425 bp, Homo sapiens
  misc_feature: HIJSMM301B9BQY.40.7.A07.1.454.light.4.raw
tctagcgactcacgaccggtgctcgatttagcacgtgtcgcagggggagaaattgtgttgacgcagtctccaggcaccctgtctttgtctccaggggaaagagccaccctctcctgcagggccagtcagagtgtcagcagcggctacttaggctggtaccagcagaaacctggccaggctcccaggctcctcatctatggtgcatccagcagggccactggcatcccagacaggttcagtggcagtgggtctgggacagacttcattctcaccatcagcggactggagcctgaagattttgcagtgtattactgtcagcagtatggtaactcatcgtacactttggccaggggaccaagctggagatcaaacgaactgtggctgcaccatctgtcttcatcttcccgccatctgaagtcgctaga

SEQ ID NO: 540793 - DNA, 486 bp, Homo sapiens
  misc_feature: HIJSMM301DVQ7O.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagatcagacgaactgtggcg

SEQ ID NO: 540794 - DNA, 492 bp, Homo sapiens
  misc_feature: HIJSMM301A8BKG.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcgagggaccagggtggagatcaaacgaactgtggctgcaccatctgtcttcatt

SEQ ID NO: 540795 - DNA, 520 bp, Homo sapiens; identical to SEQ ID NO: 535686
  misc_feature: HIJSMM301CCLI8.41.19.B08.1.454.light.4.raw

SEQ ID NO: 540796 - DNA, 483 bp, Homo sapiens; identical to SEQ ID NO: 535317
  misc_feature: HIJSMM301AXZZA.4.1.A01.1.454.light.4.raw

SEQ ID NO: 540797 - DNA, 372 bp, Homo sapiens
  misc_feature: HIJSMM301CV5BC.40.9.A09.1.454.light.4.raw
tctagcgactcacgaccggtgctcgatttagcgagacgcgcaggggacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 540798 - DNA, 384 bp, Homo sapiens
  misc_feature: HIJSMM301D24D7.17.25.C03.1.454.light.4.raw
cgtagactagcacgaccggtgctcgatttagtagtgtagatttgggtttgggagggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtcttcatcttcccgccatctgactagtctacg

SEQ ID NO: 540799 - DNA, 472 bp, Homo sapiens
  misc_feature: HIJSMM301BX51F.13.59.F04.1.454.light.4.raw
tcacgtactacacgaccggtgctcgatttagtacacacacttagggattggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgctgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaa

SEQ ID NO: 540800 - DNA, 501 bp, Homo sapiens; identical to SEQ ID NO: 536142
  misc_feature: HIJSMM301D0CFZ.15.1.A01.1.454.light.4.raw

SEQ ID NO: 540801 - DNA, 447 bp, Homo sapiens; identical to SEQ ID NO: 535020
  misc_feature: HIJSMM301ER9XS.18.9.A09.1.454.light.4.raw

SEQ ID NO: 540802 - DNA, 465 bp, Homo sapiens
  misc_feature: HIJSMM301CWMQO.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagattttcactctcaccatcagcagcctgcagcctgaagatgttgcaacttattactgtcaaaagaatagcgctgccccgctcagtttcggcggagggaccaaggtggagata

SEQ ID NO: 540803 - DNA, 502 bp, Homo sapiens
  misc_feature: HIJSMM301E1XAF.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtggggacagggaggctgcgattttcggcggagggaccaggtctgaccgtcctaggtcagcccaaggcctgccccctcggtcactctcg

SEQ ID NO: 540804 - DNA, 485 bp, Homo sapiens
  misc_feature: HIJSMM301D96W2.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccgaagctgaccgtcctaggtcagacccg

SEQ ID NO: 540805 - DNA, 488 bp, Homo sapiens; identical to SEQ ID NO: 535081
  misc_feature: HIJSMM301D7GW1.26.23.C01.1.454.light.4.raw

SEQ ID NO: 540806 - DNA, 513 bp, Homo sapiens
  misc_feature: HIJSMM301C8L8B.48.27.C05.1.454.light.4.raw
  modified_base (506)..(506): a, c, t, g, unknown or other
agtatacatacacgaccggtgctcgatttagacgcgatcgaagggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccnccctcct

SEQ ID NO: 540807 - DNA, 492 bp, Homo sapiens
  misc_feature: HIJSMM301CH2M3.41.10.A10.1.454.light.4.raw
tctatactatcacgaccggtgctcgatttagcgtcgatctcaggggatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcatcttccccg

SEQ ID NO: 540808 - DNA, 486 bp, Homo sapiens
  misc_feature: HIJSMM301DK4Z5.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaaacgaactgtggctgcacca

SEQ ID NO: 540809 - DNA, 484 bp, Homo sapiens; identical to SEQ ID NO: 537878
  misc_feature: HIJSMM301AWJKP.17.34.D01.1.454.light.4.raw

SEQ ID NO: 540810 - DNA, 508 bp, Homo sapiens
  misc_feature: HIJSMM301AKI6H.22.65.F10.1.454.light.4.raw
  modified_base (485)..(485): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgactcaccttccgtccgaacggaacgacgactggagaattaaacgtaaactgtggtcgtncgaccactcttcgtctttctact

SEQ ID NO: 540811 - DNA, 501 bp, Homo sapiens
  misc_feature: HIJSMM301DQP5S.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatattttctatcctccgtggacgttcggccaagggaccagggtggaaatcagacgaactgtggctgcaccat

SEQ ID NO: 540812 - DNA, 490 bp, Homo sapiens
  misc_feature: HIJSMM301C3TZD.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgactgactaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaa

SEQ ID NO: 540813 - DNA, 492 bp, Homo sapiens; identical to SEQ ID NO: 536087
  misc_feature: HIJSMM301B1WRO.10.17.B06.1.454.light.4.raw

SEQ ID NO: 540814 - DNA, 438 bp, Homo sapiens
  misc_feature: HIJSMM301D0CXR.51.78.H01.1.454.light.4.raw
cgatcgtatacacgaccggtgctcgatttagtgtgagtagtttgggtttgggtagtttgggtttggggctttccccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaactgtggctgcaccatctgtcttcatcttcccgccatctgatcgtagcact

SEQ ID NO: 540815 - DNA, 487 bp, Homo sapiens
  misc_feature: HIJSMM301DRMFC.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcgtggaccaggtcaccgtcctaggtcagcccaaggcccaaccca

SEQ ID NO: 540816 - DNA, 484 bp, Homo sapiens
  misc_feature: HIJSMM301AZU4R.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacatattttagtgctccgtacacttttggccaggggaccaagttggagatcaaacgaa

SEQ ID NO: 540817 - DNA, 509 bp, Homo sapiens
  misc_feature: HIJSMM301AU3NW.8.33.C11.1.454.light.4.raw
ctcgcgtgtccacgaccggtgctcgatttagagtgagctcgttgggtttggggaggaactgctcagttaggacccagagggaaccatgtaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactagtggctgcaccatctgtcttcta

SEQ ID NO: 540818 - DNA, 484 bp, Homo sapiens; identical to SEQ ID NO: 538211
  misc_feature: HIJSMM301CFIFP.47.78.H01.1.454.light.4.raw

SEQ ID NO: 540819 - DNA, 497 bp, Homo sapiens
  misc_feature: HIJSMM301BRN7D.16.68.G02.1.454.light.4.raw
tgtactactccacgaccggtgctcgatttagtcgatagtgaagggaaaggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcaacagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatcttccccg

SEQ ID NO: 540820 - DNA, 441 bp, Homo sapiens; identical to SEQ ID NO: 534971
  misc_feature: HIJSMM301BT77F.11.3.A03.1.454.light.4.raw

SEQ ID NO: 540821 - DNA, 478 bp, Homo sapiens; identical to SEQ ID NO: 535129
  misc_feature: HIJSMM301DDDNO.11.11.A11.1.454.light.4.raw

SEQ ID NO: 540822 - DNA, 487 bp, Homo sapiens
  misc_feature: HIJSMM301CGEGK.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacaagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaacccc

SEQ ID NO: 540823 - DNA, 508 bp, Homo sapiens
  misc_feature: HIJSMM301AE3NZ.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccgacggggaccggaacgactggaggatcaaacgaaacctagtggcgtgcaccactctgtcttt

SEQ ID NO: 540824 - DNA, 502 bp, Homo sapiens
  misc_feature: HIJSMM301B4XUG.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggccggagggaccaaggtggagatcaaacgaactgtggctgcaccatctgtcttcatcttcccg

SEQ ID NO: 540825 - DNA, 527 bp, Homo sapiens
  misc_feature: HIJSMM301DCJ5O.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggcctatctacgttcggcggacggacgaggtacgacctacgaaacgtactggtgtcgtgaccactactcttcgttccttactacttcccgttccccgacct

SEQ ID NO: 540826 - DNA, 503 bp, Homo sapiens; identical to SEQ ID NO: 536834
  misc_feature: HIJSMM301BL6XT.2.35.D02.1.454.light.4.raw

SEQ ID NO: 540827 - DNA, 488 bp, Homo sapiens
  misc_feature: HIJSMM301A8NMV.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactgtggctgcaccat

SEQ ID NO: 540828 - DNA, 470 bp, Homo sapiens; identical to SEQ ID NO: 535302
  misc_feature: HIJSMM301C175N.13.76.G10.1.454.light.4.raw

SEQ ID NO: 540829 - DNA, 494 bp, Homo sapiens; identical to SEQ ID NO: 535629
  misc_feature: HIJSMM301C7CSF.4.27.C05.1.454.light.4.raw

SEQ ID NO: 540830 - DNA, 494 bp, Homo sapiens; identical to SEQ ID NO: 536444
  misc_feature: HIJSMM301CTFNI.26.72.G06.1.454.light.4.raw

SEQ ID NO: 540831 - DNA, 492 bp, Homo sapiens
  misc_feature: HIJSMM301CG0VI.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaac

SEQ ID NO: 540832 - DNA, 485 bp, Homo sapiens
  misc_feature: HIJSMM301C2QS4.49.34.D01.1.454.light.4.raw
agtcgagagacacgaccggtgctcgatttagatcgtctgtgttgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctttttggccaggggaccaagctggagatcaagcgaactgtggctgcaccatctgtt

SEQ ID NO: 540833 - DNA, 488 bp, Homo sapiens; identical to SEQ ID NO: 535861
  misc_feature: HIJSMM301DC61K.14.55.E11.1.454.light.4.raw

SEQ ID NO: 540834 - DNA, 496 bp, Homo sapiens
  misc_feature: HIJSMM301BSOQF.10.65.F10.1.454.light.4.raw
  modified_base (454)..(454): a, c, t, g, unknown or other
  modified_base (467)..(467): a, c, t, g, unknown or other
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtgngatcaaacgaacngtggctgcacatctgtcttcatcttcccg

SEQ ID NO: 540835 - DNA, 513 bp, Homo sapiens
  misc_feature: HIJSMM301AVZ1W.17.33.C11.1.454.light.4.raw
  modified_base (443)..(443): a, c, t, g, unknown or other
  modified_base (464)..(464): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggnggagggaccaagctgaccgtnttaagtcagcccaaggctgccccctcggtcactctgttcccaccctcct

SEQ ID NO: 540836 - DNA, 500 bp, Homo sapiens
  misc_feature: HIJSMM301A2MNG.3.10.A10.1.454.light.4.raw
agacgcactccacgaccggtgctcgatttagcgtcgatctcagggggaggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcatcttcccgccta

SEQ ID NO: 540837 - DNA, 444 bp, Homo sapiens; identical to SEQ ID NO: 535594
  misc_feature: HIJSMM301B09DP.9.9.A09.1.454.light.4.raw

SEQ ID NO: 540838 - DNA, 495 bp, Homo sapiens
  misc_feature: HIJSMM301BNGUU.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccgaaggtggagatcaaacgaactgtggctgcaccatctgtcttcatcttcccg

SEQ ID NO: 540839 - DNA, 498 bp, Homo sapiens
  misc_feature: HIJSMM301B7OOW.48.38.D05.1.454.light.4.raw
agtatacatacacgaccggtgctcgatttagtatctgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcg

SEQ ID NO: 540840 - DNA, 504 bp, Homo sapiens
  misc_feature: HIJSMM301DY5E8.48.36.D03.1.454.light.4.raw
agtatacatacacgaccggtgctcgatttagctgcgtcacgagctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttctaagttcctttttgtcttcggaactgggaccgaggtcaccgtcctaggtcagcccaaggccaacccactgtcta

SEQ ID NO: 540841 - DNA, 487 bp, Homo sapiens
  misc_feature: HIJSMM301BTY2N.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatcaaacgaa

SEQ ID NO: 540842 - DNA, 443 bp, Homo sapiens; identical to SEQ ID NO: 537723
  misc_feature: HIJSMM301CZ0U5.8.73.G07.1.454.light.4.raw

SEQ ID NO: 540843 - DNA, 492 bp, Homo sapiens
  misc_feature: HIJSMM301BQPS5.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggcccaacccactgtcact

SEQ ID NO: 540844 - DNA, 483 bp, Homo sapiens
  misc_feature: HIJSMM301CHU8X.48.35.D02.1.454.light.4.raw
agtatacatacacgaccggtgctcgatttagcacacgatagttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 540845 - DNA, 486 bp, Homo sapiens
  misc_feature: HIJSMM301BL0RN.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtcaggggaccaagctggagatcaaacgaa

SEQ ID NO: 540846 - DNA, 475 bp, Homo sapiens
  misc_feature: HIJSMM301D3ZS3.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtattcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcacg

SEQ ID NO: 540847 - DNA, 469 bp, Homo sapiens
  misc_feature: HIJSMM301B2VEH.51.77.G11.1.454.light.4.raw
cgatcgtatacacgaccggtgctcgatttagctagtcactcaagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttacttcaccatcagcagactgcagcctgaagatgttgcaacatattactgtcaacagtatcataatctcccgctcacttttcggcggagggaccaaggtggagatcaaacgaa

SEQ ID NO: 540848 - DNA, 512 bp, Homo sapiens
  misc_feature: HIJSMM301AY28H.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcaggcaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagccccaaggctcgccccccg

SEQ ID NO: 540849 - DNA, 498 bp, Homo sapiens
  misc_feature: HIJSMM301BR40R.49.62.F07.1.454.light.4.raw
agtcgagagacacgaccggtgctcgatttagtagtcgcataaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 540850 - DNA, 472 bp, Homo sapiens; identical to SEQ ID NO: 536302
  misc_feature: HIJSMM301AQ0SF.18.76.G10.1.454.light.4.raw

SEQ ID NO: 540851 - DNA, 493 bp, Homo sapiens
  misc_feature: HIJSMM301CKIZ6.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggcttcggcggagggaccaagctgaccgtcctaggtcagcccaaggctgccccctcggtcactctgttcccgccctcttcgctacgtaga

SEQ ID NO: 540852 - DNA, 488 bp, Homo sapiens; identical to SEQ ID NO: 536742
  misc_feature: HIJSMM301B6EBQ.3.72.G06.1.454.light.4.raw

SEQ ID NO: 540853 - DNA, 490 bp, Homo sapiens
  misc_feature: HIJSMM301DM3GW.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcacca

SEQ ID NO: 540854 - DNA, 509 bp, Homo sapiens
  misc_feature: HIJSMM301DV178.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctgttccccg

SEQ ID NO: 540855 - DNA, 509 bp, Homo sapiens; identical to SEQ ID NO: 540142
  misc_feature: HIJSMM301D98R6.8.38.D05.1.454.light.4.raw

SEQ ID NO: 540856 - DNA, 512 bp, Homo sapiens
  misc_feature: HIJSMM301DLZ16.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaatttctacttactcagcccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 540857 - DNA, 496 bp, Homo sapiens
  misc_feature: HIJSMM301EIK27.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcactatctgt

SEQ ID NO: 540858 - DNA, 494 bp, Homo sapiens
  misc_feature: HIJSMM301CQSOZ.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattccttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 540859 - DNA, 469 bp, Homo sapiens; identical to SEQ ID NO: 536091
  misc_feature: HIJSMM301APD7V.3.82.H05.1.454.light.4.raw

SEQ ID NO: 540860 - DNA, 500 bp, Homo sapiens
  misc_feature: HIJSMM301AI5BZ.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggtccgacgggacggacgacgtggtaggattaaacgtaaacctagtggcgtgcacccatctcgtt

SEQ ID NO: 540861 - DNA, 494 bp, Homo sapiens; identical to SEQ ID NO: 535680
  misc_feature: HIJSMM301CR444.16.78.H01.1.454.light.4.raw

SEQ ID NO: 540862 - DNA, 447 bp, Homo sapiens; identical to SEQ ID NO: 535201
  misc_feature: HIJSMM301EA01F.18.9.A09.1.454.light.4.raw

SEQ ID NO: 540863 - DNA, 489 bp, Homo sapiens
  misc_feature: HIJSMM301EIHGQ.12.31.C09.1.454.light.4.raw
  modified_base (430)..(430): a, c, t, g, unknown or other
atacgacgtacacgaccggtgctcgatttagacgtctcatcaaggaaggaaggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgntcccatcacttttcggccaagggacacgaccgcagattggacgaactgtggctgcaacc

SEQ ID NO: 540864 - DNA, 484 bp, Homo sapiens
  misc_feature: HIJSMM301DMULM.40.28.C06.1.454.light.4.raw
tctagcgactcacgaccggtgctcgatttagagctcacgtattgggtttgggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcacc

SEQ ID NO: 540865 - DNA, 487 bp, Homo sapiens; identical to SEQ ID NO: 538190
  misc_feature: HIJSMM301AINT7.47.70.G04.1.454.light.4.raw

SEQ ID NO: 540866 - DNA, 419 bp, Homo sapiens
  misc_feature: HIJSMM301EHAWT.48.82.H05.1.454.light.4.raw
agtatacatacacgaccggtgctcgatttagtcgagctctctcgcgggcacgaccggtgctcgatttagagtgagctcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 540867 - DNA, 501 bp, Homo sapiens
  misc_feature: HIJSMM301BYA63.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggacgacgactgaggatcaaccgaaccgtagtggcgtcgcaccactctgtt

SEQ ID NO: 540868 - DNA, 497 bp, Homo sapiens; identical to SEQ ID NO: 536807
  misc_feature: HIJSMM301DPU83.10.37.D04.1.454.light.4.raw

SEQ ID NO: 540869 - DNA, 447 bp, Homo sapiens; identical to SEQ ID NO: 535020
  misc_feature: HIJSMM301CY2VQ.18.9.A09.1.454.light.4.raw

SEQ ID NO: 540870 - DNA, 485 bp, Homo sapiens
  misc_feature: HIJSMM301C8RUG.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgatgttcggccaagggccaaggtggaaatcaaacgaactgtggctgcacc

SEQ ID NO: 540871 - DNA, 472 bp, Homo sapiens
  misc_feature: HIJSMM301EFEVK.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaa

SEQ ID NO: 540872 - DNA, 508 bp, Homo sapiens; identical to SEQ ID NO: 536388
  misc_feature: HIJSMM301CVG9F.11.57.F02.1.454.light.4.raw

SEQ ID NO: 540873 - DNA, 479 bp, Homo sapiens
  misc_feature: HIJSMM301CDY9W.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccccg

SEQ ID NO: 540874 - DNA, 499 bp, Homo sapiens
  misc_feature: HIJSMM301BPGWY.21.38.D05.1.454.light.4.raw
tcgtcgctcgcacgaccggtgctcgatttagtatctgatagttgggtttgggggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggggaccaaggtggagatcagacgaactgtggctgcaccatctgtcttcatt

SEQ ID NO: 540875 - DNA, 486 bp, Homo sapiens; identical to SEQ ID NO: 535043
  misc_feature: HIJSMM301BKC76.46.35.D02.1.454.light.4.raw

SEQ ID NO: 540876 - DNA, 347 bp, Homo sapiens
  misc_feature: HIJSMM301B26M5.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggccaggggaccaagctggagatcaagcgaactgtggctgcaccatctgtcttcatcttcccgcactgatagtacgtga

SEQ ID NO: 540877 - DNA, 498 bp, Homo sapiens
  misc_feature: HIJSMM301A3EOG.48.72.G06.1.454.light.4.raw
agtatacatacacgaccggtgctcgatttagctacgactgcaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagactttttagtttacgtcggaccttcggccaagggacacgactggagattaaacgaactagtgg

SEQ ID NO: 540878 - DNA, 462 bp, Homo sapiens
  misc_feature: HIJSMM301AN59M.51.16.B05.1.454.light.4.raw
cgatcgtatacacgaccggtgctcgatttagagctcacgtaagggggaactgctcagttaggacccagacggaaccatggaagccccagctcagcttctcttcctcctgctactctggctcccaggggaaagagtcaccctctcctacagggccagtcagagtgttagcagcagctgcttaacctggtatcagcagaaacctggccaggcgcccagactcctcatctatggtgcatccaccagggccactagcatcccagccaggttcagtggcagtgggtctgggacagacttcactctcaccatcagcagcctgcagcctgaagattttgcagtttattactgtcagcaggattataacttacctccggggggacgttcggccaagggaccaaagtggaaatcaagcgaactgtggctgcaccatctgtcttcatcttcccgccatctgatcgtagcact

SEQ ID NO: 540879 - DNA, 490 bp, Homo sapiens; identical to SEQ ID NO: 535234
  misc_feature: HIJSMM301CFQVP.17.21.B10.1.454.light.4.raw

SEQ ID NO: 540880 - DNA, 493 bp, Homo sapiens
  misc_feature: HIJSMM301DXXE9.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacca

SEQ ID NO: 540881 - DNA, 502 bp, Homo sapiens; identical to SEQ ID NO: 536253
  misc_feature: HIJSMM301CBZUE.21.22.B11.1.454.light.4.raw

SEQ ID NO: 540882 - DNA, 520 bp, Homo sapiens
  misc_feature: HIJSMM301B2E97.48.58.F03.1.454.light.4.raw
agtatacatacacgaccggtgctcgatttagtctgatcgagaagggaaaggggctgggcctaaggaagcagcactggtggtgcctcagccatggcctggaccgttctcctcctcggcctcctctctcactgcacaggctccgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 540883 - DNA, 444 bp, Homo sapiens; identical to SEQ ID NO: 535594
  misc_feature: HIJSMM301EOB61.9.9.A09.1.454.light.4.raw

SEQ ID NO: 540884 - DNA, 504 bp, Homo sapiens; identical to SEQ ID NO: 535561
  misc_feature: HIJSMM301AQI5Z.4.57.F02.1.454.light.4.raw

SEQ ID NO: 540885 - DNA, 382 bp, Homo sapiens
  misc_feature: HIJSMM301ELFFP.48.87.H10.1.454.light.4.raw
agtatacatacacgaccggtgctcgatttagcagtactgcgttgggtttggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 540886 - DNA, 454 bp, Homo sapiens
  misc_feature: HIJSMM301AHGIW.19.86.H09.1.454.light.4.raw
tactctcgtgcacgaccggtgctcgatttagtgctatagacttgggtttggggccgttcctgggcccagtctgtgctgactcaggcaccctcagcgtctggggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccgccctcctccacgagagta

SEQ ID NO: 540887 - DNA, 497 bp, Homo sapiens; identical to SEQ ID NO: 538030
  misc_feature: HIJSMM301CVSQU.40.23.C01.1.454.light.4.raw

SEQ ID NO: 540888 - DNA, 492 bp, Homo sapiens; identical to SEQ ID NO: 535335
  misc_feature: HIJSMM301BLHG8.16.53.E09.1.454.light.4.raw

SEQ ID NO: 540889 - DNA, 507 bp, Homo sapiens
  misc_feature: HIJSMM301DKFBX.17.43.D10.1.454.light.4.raw
  modified_base (456)..(456): a, c, t, g, unknown or other
  modified_base (487)..(487): a, c, t, g, unknown or other
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgtagtttattactgtcagcactataataactggcccccgggggaggtcggtcgacggacgacgtaggngatacaacgaaacgtgtggcgtgcaccactntcgtcttcctatcttccccg

SEQ ID NO: 540890 - DNA, 484 bp, Homo sapiens; identical to SEQ ID NO: 535400
  misc_feature: HIJSMM301CD7WD.46.26.C04.1.454.light.4.raw

SEQ ID NO: 540891 - DNA, 469 bp, Homo sapiens
  misc_feature: HIJSMM301CZYHK.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacaatatgataatctaccactcactttcggcggagggaccacggtggagatcaacgaactgt

SEQ ID NO: 540892 - DNA, 489 bp, Homo sapiens
  misc_feature: HIJSMM301COPCJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccaaggcggagatcagacgaactgtggctgcaccatctgtcttcta

SEQ ID NO: 540893 - DNA, 511 bp, Homo sapiens
  misc_feature: HIJSMM301DQOWJ.9.43.D10.1.454.light.4.raw
tgatacgtctcacgaccggtgctcgatttagactagcagtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactctgttcccaccctcctcacg

SEQ ID NO: 540894 - DNA, 487 bp, Homo sapiens
  misc_feature: HIJSMM301A5VOO.48.37.D04.1.454.light.4.raw
agtatacatacacgaccggtgctcgatttagtagcatactgttgggtttgggctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggaggaccaag

SEQ ID NO: 540895 - DNA, 504 bp, Homo sapiens
  misc_feature: HIJSMM301BHEGE.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcg

SEQ ID NO: 540896 - DNA, 465 bp, Homo sapiens
  misc_feature: HIJSMM301DA5JL.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagata

SEQ ID NO: 540897 - DNA, 509 bp, Homo sapiens
  misc_feature: HIJSMM301E1ILH.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggccgaagtggagctcaacgaactgtggctgcaccatctgtcttctatcttcccgt

SEQ ID NO: 540898 - DNA, 512 bp, Homo sapiens
  misc_feature: HIJSMM301C5BG4.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 540899 - DNA, 463 bp, Homo sapiens; identical to SEQ ID NO: 535062
  misc_feature: HIJSMM301CES25.11.73.G07.1.454.light.4.raw

SEQ ID NO: 540900 - DNA, 502 bp, Homo sapiens
  misc_feature: HIJSMM301B2MO2.52.34.D01.1.454.light.4.raw
cgcagtacgacacgaccggtgctcgatttagatcgtctgtgttgggtttgggggctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttcccgccta

SEQ ID NO: 540901 - DNA, 518 bp, Homo sapiens
  misc_feature: HIJSMM301C1R9C.49.10.A10.1.454.light.4.raw
agtcgagagacacgaccggtgctcgatttagcgtcgatctcaggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgccctcctctctc

SEQ ID NO: 540902 - DNA, 495 bp, Homo sapiens; identical to SEQ ID NO: 535007
  misc_feature: HIJSMM301ESQ6U.22.5.A05.1.454.light.4.raw

SEQ ID NO: 540903 - DNA, 493 bp, Homo sapiens
  misc_feature: HIJSMM301BWX9B.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattctactttcggccctgggaccaaagtggatttcagacgaactgtggctgcaccatctgtcttcta

SEQ ID NO: 540904 - DNA, 471 bp, Homo sapiens; identical to SEQ ID NO: 536918
  misc_feature: HIJSMM301AJUGE.4.75.G09.1.454.light.4.raw

SEQ ID NO: 540905 - DNA, 444 bp, Homo sapiens; identical to SEQ ID NO: 535027
  misc_feature: HIJSMM301A1HG6.8.73.G07.1.454.light.4.raw

SEQ ID NO: 540906 - DNA, 492 bp, Homo sapiens; identical to SEQ ID NO: 540472
  misc_feature: HIJSMM301BUDYR.48.37.D04.1.454.light.4.raw

SEQ ID NO: 540907 - DNA, 494 bp, Homo sapiens
  misc_feature: HIJSMM301D6VCD.26.72.G06.1.454.light.4.raw
  modified_base (466)..(466): a, c, t, g, unknown or other
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggtccagggacccaggtggagatcagacgaactgnggctgcaccatctgtcttcatcttcccg

SEQ ID NO: 540908 - DNA, 520 bp, Homo sapiens; identical to SEQ ID NO: 535773
  misc_feature: HIJSMM301C9CW1.41.19.B08.1.454.light.4.raw

SEQ ID NO: 540909 - DNA, 468 bp, Homo sapiens
  misc_feature: HIJSMM301CP4SO.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagatttgcaacttactattgtcaacaggctgacagtctcccgctcactttcggcggagggaccaaggtggagatcaaacgaa

SEQ ID NO: 540910 - DNA, 490 bp, Homo sapiens
  misc_feature: HIJSMM301DDT0I.40.12.B01.1.454.light.4.raw
tctagcgactcacgaccggtgctcgatttagtagtgtagattcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcacc

SEQ ID NO: 540911 - DNA, 488 bp, Homo sapiens
  misc_feature: HIJSMM301BXYV7.48.53.E09.1.454.light.4.raw
agtatacatacacgaccggtgctcgatttagagagagtgtgttgggtttggggagagctctggagaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaa

SEQ ID NO: 540912 - DNA, 496 bp, Homo sapiens; identical to SEQ ID NO: 537925
  misc_feature: HIJSMM301C6U0M.22.14.B03.1.454.light.4.raw

SEQ ID NO: 540913 - DNA, 494 bp, Homo sapiens
  misc_feature: HIJSMM301DTY7T.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatcttccg

SEQ ID NO: 540914 - DNA, 499 bp, Homo sapiens
  misc_feature: HIJSMM301AV8RY.9.12.B01.1.454.light.4.raw
  modified_base (450)..(450): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaggacgacgnggaagtacaacgaactagtggctgcaccactctgtcttcatcttccccg

SEQ ID NO: 540915 - DNA, 476 bp, Homo sapiens
  misc_feature: HIJSMM301BUK5M.51.35.D02.1.454.light.4.raw
cgatcgtatacacgaccggtgctcgatttagcacacgatagttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggacgaacggtggagatcaagagaactgtggcgtgca

SEQ ID NO: 540916 - DNA, 383 bp, Homo sapiens
  misc_feature: HIJSMM301BLWQA.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcattctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 540917 - DNA, 497 bp, Homo sapiens
  misc_feature: HIJSMM301EMG2H.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcacgcctgcaggctgaagatgtggcagtttattactgtcagcaatattatagtactcctccgaggctcactttcggcggagggaccaaggtggagatcaaacgaactgt

SEQ ID NO: 540918 - DNA, 516 bp, Homo sapiens
  misc_feature: HIJSMM301CW7GO.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcagggcccaacccttggatgagggtgactattctgtcaagtgtgggacaccaacacttgtgtcttcgggactgggaccgaggtcaccgtcctaagtcagcccagggccaacccactgtcactctgttcccgaccctcctcgacacg

SEQ ID NO: 540919 - DNA, 498 bp, Homo sapiens
  misc_feature: HIJSMM301C7KQS.5.23.C01.1.454.light.4.raw
atcagacacgcacgaccggtgctcgatttagtacacgtgattagggattgggcacgaccggtgctcgatttagtacacgtgattagggattgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggt

SEQ ID NO: 540920 - DNA, 486 bp, Homo sapiens; identical to SEQ ID NO: 536261
  misc_feature: HIJSMM301AW8VD.26.55.E11.1.454.light.4.raw

SEQ ID NO: 540921 - DNA, 473 bp, Homo sapiens
  misc_feature: HIJSMM301ATLAH.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagattttgcaactttactactgtcaacagagtttcagtatcccttggactttcgccgaaggaccaaggtaggaatacaacgaa

SEQ ID NO: 540922 - DNA, 488 bp, Homo sapiens
  misc_feature: HIJSMM301BOSYL.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctnactttcggcggagggaccaaggcggagatcagacgaactgtggctgcaccatctgtcttca

SEQ ID NO: 540923 - DNA, 499 bp, Homo sapiens
  misc_feature: HIJSMM301DQXUH.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattgctgcctgcagagtattcactggccgtggacgttcggccaagggaccaaggtggaaatcaaacgaactgtggctgcacca

SEQ ID NO: 540924 - DNA, 488 bp, Homo sapiens; identical to SEQ ID NO: 537260
  misc_feature: HIJSMM301COM4F.47.70.G04.1.454.light.4.raw

SEQ ID NO: 540925 - DNA, 463 bp, Homo sapiens; identical to SEQ ID NO: 535062
  misc_feature: HIJSMM301EA3KD.11.73.G07.1.454.light.4.raw

SEQ ID NO: 540926 - DNA, 489 bp, Homo sapiens
  misc_feature: HIJSMM301AFSG9.5.64.F09.1.454.light.4.raw
atcagacacgcacgaccggtgctcgatttagcgcgtatacaaggggcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccgaaggtcgaaatgagacgaactgtggctgcaccatctgtcttctatcttccccg

SEQ ID NO: 540927 - DNA, 416 bp, Homo sapiens; identical to SEQ ID NO: 539343
  misc_feature: HIJSMM301AGS5A.18.78.H01.1.454.light.4.raw

SEQ ID NO: 540928 - DNA, 480 bp, Homo sapiens
  misc_feature: HIJSMM301DFQ1M.43.7.A07.1.454.light.4.raw
tgtgagtagtcacgaccggtgctcgatttagcacgtgtcgcagggggctggggtctcaggaggcagcactctcgggacgtctccaccatggcctgggctctgctcctcctcagcctcctcactcagggcacaggatcgtggtctcagtctgccctgactcagcctcgctctctatccgggtctcctggacagtcagtcaccatcccctgcactggaaccagcaatgatgttggtacttataatcatgtctcctggtaccaacaatacccaggcaaggcccccaaactcatcatttatcatgtcagtgagcggccctcaggggtccctgatcgcttctctggctccaagtctggcaacacggcctccctgaccatctctgggctccagggtgaggatgaggctgaatattattgctgctcatatgctgtcatgggaggcagtttgtgggtgttcggcggagggacccagctgaccgtccta

SEQ ID NO: 540929 - DNA, 480 bp, Homo sapiens
  misc_feature: HIJSMM301EJJYF.13.59.F04.1.454.light.4.raw
tcacgtactacacgaccggtgctcgatttagtacacacacttagggattgggggcgagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 540930 - DNA, 507 bp, Homo sapiens
  misc_feature: HIJSMM301EPUGN.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttcta

SEQ ID NO: 540931 - DNA, 520 bp, Homo sapiens; identical to SEQ ID NO: 538570
  misc_feature: HIJSMM301B4END.27.23.C01.1.454.light.4.raw

SEQ ID NO: 540932 - DNA, 361 bp, Homo sapiens; identical to SEQ ID NO: 540413
  misc_feature: HIJSMM301D3AMW.3.57.F02.1.454.light.4.raw

SEQ ID NO: 540933 - DNA, 508 bp, Homo sapiens
  misc_feature: HIJSMM301BGF7J.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctgtt

SEQ ID NO: 540934 - DNA, 497 bp, Homo sapiens
  misc_feature: HIJSMM301AMWW2.19.67.G01.1.454.light.4.raw
tactctcgtgcacgaccggtgctcgatttagagtatacatattgggtttggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttcttatcctccgtggacgttcggccaagggaccagggtggaaatacagacgaactgtggct

SEQ ID NO: 540935 - DNA, 484 bp, Homo sapiens; identical to SEQ ID NO: 535400
  misc_feature: HIJSMM301CT4W8.46.26.C04.1.454.light.4.raw

SEQ ID NO: 540936 - DNA, 490 bp, Homo sapiens; identical to SEQ ID NO: 535526
  misc_feature: HIJSMM301ASRLT.26.78.H01.1.454.light.4.raw

SEQ ID NO: 540937 - DNA, 486 bp, Homo sapiens
  misc_feature: HIJSMM301A3J1O.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggataatcaaacgaactgtggctgcaccatctgtt

SEQ ID NO: 540938 - DNA, 489 bp, Homo sapiens; identical to SEQ ID NO: 535091
  misc_feature: HIJSMM301B8D10.47.36.D03.1.454.light.4.raw

SEQ ID NO: 540939 - DNA, 496 bp, Homo sapiens
  misc_feature: HIJSMM301D2Z68.22.65.F10.1.454.light.4.raw
  modified_base (479)..(479): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatcaccttccggtccgaacggacgacgactggagattaaacgaactgtgcgtncgaccatctgtcttcat

SEQ ID NO: 540940 - DNA, 482 bp, Homo sapiens; identical to SEQ ID NO: 537007
  misc_feature: HIJSMM301BUBF5.41.34.D01.1.454.light.4.raw

SEQ ID NO: 540941 - DNA, 490 bp, Homo sapiens
  misc_feature: HIJSMM301BJAWV.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggaggatcaaacgaactgtggctgcaccat

SEQ ID NO: 540942 - DNA, 518 bp, Homo sapiens
  misc_feature: HIJSMM301DVDPZ.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccgt

SEQ ID NO: 540943 - DNA, 444 bp, Homo sapiens; identical to SEQ ID NO: 536096
  misc_feature: HIJSMM301AHV9D.7.18.B07.1.454.light.4.raw

SEQ ID NO: 540944 - DNA, 507 bp, Homo sapiens; identical to SEQ ID NO: 535316
  misc_feature: HIJSMM301AI7G9.18.37.D04.1.454.light.4.raw

SEQ ID NO: 540945 - DNA, 498 bp, Homo sapiens; identical to SEQ ID NO: 538749
  misc_feature: HIJSMM301C10SL.43.34.D01.1.454.light.4.raw

SEQ ID NO: 540946 - DNA, 514 bp, Homo sapiens; identical to SEQ ID NO: 538885
  misc_feature: HIJSMM301CG17I.14.19.B08.1.454.light.4.raw

SEQ ID NO: 540947 - DNA, 479 bp, Homo sapiens
  misc_feature: HIJSMM301D1H6B.52.1.A01.1.454.light.4.raw
cgcagtacgacacgaccggtgctcgatttagacgtctcatcagggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtt

SEQ ID NO: 540948 - DNA, 496 bp, Homo sapiens
  misc_feature: HIJSMM301CWKOZ.26.26.C04.1.454.light.4.raw
  modified_base (474)..(474): a, c, t, g, unknown or other
  modified_base (488)..(488): a, c, t, g, unknown or other
  modified_base (492)..(492): a, c, t, g, unknown or other
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcgaggcactgatttcacgctgaagatcagcagggtggaggctgaggatgttgcggtttattacttgcctgcagagattcactggccgtggacgtgtcgacgacgacgaggaaganaacgaacaacgagngtgngcac

SEQ ID NO: 540949 - DNA, 492 bp, Homo sapiens; identical to SEQ ID NO: 536733
  misc_feature: HIJSMM301AEKAT.40.11.A11.1.454.light.4.raw

SEQ ID NO: 540950 - DNA, 498 bp, Homo sapiens; identical to SEQ ID NO: 537020
  misc_feature: HIJSMM301DU6F9.26.26.C04.1.454.light.4.raw

SEQ ID NO: 540951 - DNA, 486 bp, Homo sapiens; identical to SEQ ID NO: 535290
  misc_feature: HIJSMM301ELIJJ.3.12.B01.1.454.light.4.raw

SEQ ID NO: 540952 - DNA, 477 bp, Homo sapiens; identical to SEQ ID NO: 535122
  misc_feature: HIJSMM301A6BZN.26.72.G06.1.454.light.4.raw

SEQ ID NO: 540953 - DNA, 477 bp, Homo sapiens; identical to SEQ ID NO: 535122
  misc_feature: HIJSMM301BEDUT.26.72.G06.1.454.light.4.raw

SEQ ID NO: 540954 - DNA, 518 bp, Homo sapiens; identical to SEQ ID NO: 539372
  misc_feature: HIJSMM301CWPIS.7.86.H09.1.454.light.4.raw

SEQ ID NO: 540955 - DNA, 471 bp, Homo sapiens; identical to SEQ ID NO: 539388
  misc_feature: HIJSMM301ELDEF.13.39.D06.1.454.light.4.raw

SEQ ID NO: 540956 - DNA, 489 bp, Homo sapiens; identical to SEQ ID NO: 536663
  misc_feature: HIJSMM301EHD6H.16.72.G06.1.454.light.4.raw

SEQ ID NO: 540957 - DNA, 463 bp, Homo sapiens; identical to SEQ ID NO: 535008
  misc_feature: HIJSMM301DTY7W.10.9.A09.1.454.light.4.raw

SEQ ID NO: 540958 - DNA, 487 bp, Homo sapiens
  misc_feature: HIJSMM301EV66W.48.77.G11.1.454.light.4.raw
agtatacatacacgaccggtgctcgatttagctagtcactcaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcacc

SEQ ID NO: 540959 - DNA, 463 bp, Homo sapiens; identical to SEQ ID NO: 536878
  misc_feature: HIJSMM301DXAUW.26.78.H01.1.454.light.4.raw

SEQ ID NO: 540960 - DNA, 495 bp, Homo sapiens
  misc_feature: HIJSMM301EUBPU.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggaggatcaaacgaactgtggctgcaccatctgtcttcatt

SEQ ID NO: 540961 - DNA, 454 bp, Homo sapiens; identical to SEQ ID NO: 535005
  misc_feature: HIJSMM301DJ7KE.19.86.H09.1.454.light.4.raw

SEQ ID NO: 540962 - DNA, 507 bp, Homo sapiens; identical to SEQ ID NO: 538063
  misc_feature: HIJSMM301BVUDZ.47.85.H08.1.454.light.4.raw

SEQ ID NO: 540963 - DNA, 514 bp, Homo sapiens
  misc_feature: HIJSMM301AL5ER.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcgatcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcct

SEQ ID NO: 540964 - DNA, 470 bp, Homo sapiens; identical to SEQ ID NO: 536130
  misc_feature: HIJSMM301CMASW.7.81.H04.1.454.light.4.raw

SEQ ID NO: 540965 - DNA, 447 bp, Homo sapiens; identical to SEQ ID NO: 535201
  misc_feature: HIJSMM301ENEE8.18.9.A09.1.454.light.4.raw

SEQ ID NO: 540966 - DNA, 503 bp, Homo sapiens; identical to SEQ ID NO: 538583
  misc_feature: HIJSMM301DVESY.15.59.F04.1.454.light.4.raw

SEQ ID NO: 540967 - DNA, 500 bp, Homo sapiens
  misc_feature: HIJSMM301DHH55.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctccctactcgat

SEQ ID NO: 540968 - DNA, 493 bp, Homo sapiens; identical to SEQ ID NO: 539187
  misc_feature: HIJSMM301AKEU2.14.30.C08.1.454.light.4.raw

SEQ ID NO: 540969 - DNA, 353 bp, Homo sapiens; identical to SEQ ID NO: 536338
  misc_feature: HIJSMM301DANA1.3.11.A11.1.454.light.4.raw

SEQ ID NO: 540970 - DNA, 496 bp, Homo sapiens; identical to SEQ ID NO: 536326
  misc_feature: HIJSMM301C1VR5.16.12.B01.1.454.light.4.raw

SEQ ID NO: 540971 - DNA, 503 bp, Homo sapiens; identical to SEQ ID NO: 535044
  misc_feature: HIJSMM301DHDEE.19.78.H01.1.454.light.4.raw

SEQ ID NO: 540972 - DNA, 483 bp, Homo sapiens
  misc_feature: HIJSMM301B5JCR.49.35.D02.1.454.light.4.raw
agtcgagagacacgaccggtgctcgatttagcacacgatagttgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggtccaggggaccaagctggagatcaagcgaactgtggctgcaccat

SEQ ID NO: 540973 - DNA, 492 bp, Homo sapiens
  misc_feature: HIJSMM301DBS02.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtcttcta

SEQ ID NO: 540974 - DNA, 444 bp, Homo sapiens; identical to SEQ ID NO: 534993
  misc_feature: HIJSMM301EQ88H.5.9.A09.1.454.light.4.raw

SEQ ID NO: 540975 - DNA, 493 bp, Homo sapiens
  misc_feature: HIJSMM301EFF73.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgtggc

SEQ ID NO: 540976 - DNA, 447 bp, Homo sapiens; identical to SEQ ID NO: 535020
  misc_feature: HIJSMM301CHUT1.18.9.A09.1.454.light.4.raw

SEQ ID NO: 540977 - DNA, 525 bp, Homo sapiens
  misc_feature: HIJSMM301ADFI1.49.21.B10.1.454.light.4.raw
agtcgagagacacgaccggtgctcgatttagtgtcgtcgcaaagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaacccccacctagtcacctcttgttccctacccctccctcctt

SEQ ID NO: 540978 - DNA, 508 bp, Homo sapiens
  misc_feature: HIJSMM301EU7DW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaagtacaaacgaactgtggctgcaccatctgtcttcatcttccccg

SEQ ID NO: 540979 - DNA, 498 bp, Homo sapiens; identical to SEQ ID NO: 535295
  misc_feature: HIJSMM301BTQ1P.15.25.C03.1.454.light.4.raw

SEQ ID NO: 540980 - DNA, 482 bp, Homo sapiens; identical to SEQ ID NO: 535920
  misc_feature: HIJSMM301CENBC.19.71.G05.1.454.light.4.raw

SEQ ID NO: 540981 - DNA, 520 bp, Homo sapiens; identical to SEQ ID NO: 539176
  misc_feature: HIJSMM301A8JUL.27.23.C01.1.454.light.4.raw

SEQ ID NO: 540982 - DNA, 488 bp, Homo sapiens
  misc_feature: HIJSMM301D3BBG.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggga

SEQ ID NO: 540983 - DNA, 503 bp, Homo sapiens
  misc_feature: HIJSMM301D2USZ.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 540984 - DNA, 509 bp, Homo sapiens
  misc_feature: HIJSMM301AS3RQ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatacaaacgaactgtggctgcaccatctgtcttcatcttcccgtcc

SEQ ID NO: 540985 - DNA, 504 bp, Homo sapiens; identical to SEQ ID NO: 535128
  misc_feature: HIJSMM301BFTTW.19.85.H08.1.454.light.4.raw

SEQ ID NO: 540986 - DNA, 478 bp, Homo sapiens
  misc_feature: HIJSMM301ARRO9.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 540987 - DNA, 486 bp, Homo sapiens
  misc_feature: HIJSMM301A8N25.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaaggacacgactggagattaaacgaactgtggctgcaccatctgtcttc

SEQ ID NO: 540988 - DNA, 444 bp, Homo sapiens; identical to SEQ ID NO: 535594
  misc_feature: HIJSMM301AVC3K.9.9.A09.1.454.light.4.raw

SEQ ID NO: 540989 - DNA, 485 bp, Homo sapiens; identical to SEQ ID NO: 535880
  misc_feature: HIJSMM301CLN71.7.75.G09.1.454.light.4.raw

SEQ ID NO: 540990 - DNA, 444 bp, Homo sapiens; identical to SEQ ID NO: 535856
  misc_feature: HIJSMM301BCGL2.9.9.A09.1.454.light.4.raw

SEQ ID NO: 540991 - DNA, 479 bp, Homo sapiens
  misc_feature: HIJSMM301CVB38.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttggccaggggaccaaggtcgaaatgagacgaactgtggctgcacc

SEQ ID NO: 540992 - DNA, 498 bp, Homo sapiens; identical to SEQ ID NO: 535974
  misc_feature: HIJSMM301A79SN.22.27.C05.1.454.light.4.raw

SEQ ID NO: 540993 - DNA, 476 bp, Homo sapiens
  misc_feature: HIJSMM301A7XY8.19.77.G11.1.454.light.4.raw
tactctcgtgcacgaccggtgctcgatttagctagtcactcaagggaaagggtgacatccctcactgtggctcacgttcggcggagggaccgaggtggagatcaaacgtaagtgcactatccgaatgctttttgttataaggtttgatttggaggggttttgtgtttgagatatgaggtcaggtcaattccaaagagtaccagattctttcagaaagtcagatgagtaagggacagaaacttagttcatcttaaggaacagccaagcgctagccagttaagtgaggcatctcaattgcaagattttctctgcatcggtcaggtttagtgatattaacagagaaaagagatttttgttaagggaaagtaattaagctaacactgtggatcaccttcggccaagggacacgactggagattaaacgaactgtggctgcaccatctgtcttcatcttcccgccatctgacacgagagta

SEQ ID NO: 540994 - DNA, 520 bp, Homo sapiens; identical to SEQ ID NO: 538570
  misc_feature: HIJSMM301CFGJN.27.23.C01.1.454.light.4.raw

SEQ ID NO: 540995 - DNA, 447 bp, Homo sapiens; identical to SEQ ID NO: 535020
  misc_feature: HIJSMM301DOTON.18.9.A09.1.454.light.4.raw

SEQ ID NO: 540996 - DNA, 497 bp, Homo sapiens
  misc_feature: HIJSMM301CVBDT.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtccctcctctcacggttcggcggagggaccaagggtggagatcaaaacgaactgtggctgcaccatctgtcttcatcttcccgccat

SEQ ID NO: 540997 - DNA, 497 bp, Homo sapiens; identical to SEQ ID NO: 535692
  misc_feature: HIJSMM301B79X2.7.59.F04.1.454.light.4.raw

SEQ ID NO: 540998 - DNA, 498 bp, Homo sapiens
  misc_feature: HIJSMM301EOD2R.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggcgtcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 540999 - DNA, 488 bp, Homo sapiens
  misc_feature: HIJSMM301CPR9X.52.25.C03.1.454.light.4.raw
cgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaactccttaatagttactccttcactttcggccctgggaccaaagtggacatcaaacgaactgtggctgcaccatctgt

SEQ ID NO: 541000 - DNA, 460 bp, Homo sapiens
  misc_feature: HIJSMM301BCSCC.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggccgagtcaggacgattggcatttatgtagcctggtataaggagacaccaggaaagttacctcaactcctgatctatggtgcatccactctgcacttcgggtcccgatctcggttcagcggcagcggatctgggacacatttcactctcaccatcagcagcctgcagcctgaagatgttgcagttttattactgtcaaaagtatgacactgtcccgctcactttcggcggagggaccaaggtggaga

SEQ ID NO: 541001 - DNA, 485 bp, Homo sapiens
  misc_feature: HIJSMM301E4NEZ.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaaagttatgagacccctgccactttcggtccctcgggaccgatagtaggatatgaaacgaactagtgg

SEQ ID NO: 541002 - DNA, 500 bp, Homo sapiens
  misc_feature: HIJSMM301AZFP4.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctcgccccctcggtcactctgttcccg

SEQ ID NO: 541003 - DNA, 486 bp, Homo sapiens; identical to SEQ ID NO: 535385
  misc_feature: HIJSMM301C4QVT.19.71.G05.1.454.light.4.raw

SEQ ID NO: 541004 - DNA, 441 bp, Homo sapiens; identical to SEQ ID NO: 534971
  misc_feature: HIJSMM301C3ABB.11.3.A03.1.454.light.4.raw

SEQ ID NO: 541005 - DNA, 486 bp, Homo sapiens; identical to SEQ ID NO: 535043
  misc_feature: HIJSMM301D1H6J.46.35.D02.1.454.light.4.raw

SEQ ID NO: 541006 - DNA, 492 bp, Homo sapiens
  misc_feature: HIJSMM301AWCP7.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccgaaactggatatcagacgaactgtggctgca

SEQ ID NO: 541007 - DNA, 444 bp, Homo sapiens
  misc_feature: HIJSMM301AL5MB.9.9.A09.1.454.light.4.raw
tgatacgtctcacgaccggtgctcgatttagcgagacgcgcagggtcctgggcccaatctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 541008 - DNA, 487 bp, Homo sapiens
  misc_feature: HIJSMM301DJ7UM.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacgggatgaggctgactattactgtcaggcgtgggacagcagcacctatgtggttttcggcggagggaccaagctgaccgtccttggtcagcccaaggctgcccccc

SEQ ID NO: 541009 - DNA, 497 bp, Homo sapiens
  misc_feature: HIJSMM301CJCA4.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgactgtggctgcaccatctgtcttca

SEQ ID NO: 541010 - DNA, 449 bp, Homo sapiens
  misc_feature: HIJSMM301CNXSP.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctggaggatgaggctgactattactgccagtcctatgacatgaggctgagtggttcgtatgtcttcggatctgggaccaaggtcaccgtcctaagtcagcccaaggccaacccctctgtcactctcgttcccaccctcctccatactcgta

SEQ ID NO: 541011 - DNA, 417 bp, Homo sapiens
  misc_feature: HIJSMM301EKOAB.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttcccaccctcctccatactcgta

SEQ ID NO: 541012 - DNA, 517 bp, Homo sapiens
  misc_feature: HIJSMM301C7EWD.5.27.C05.1.454.light.4.raw
atcagacacgcacgaccggtgctcgatttagacgcgatcgaagggtttgggactgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 541013 - DNA, 504 bp, Homo sapiens
  misc_feature: HIJSMM301BSJWN.9.71.G05.1.454.light.4.raw
  modified_base (320)..(320): a, c, t, g, unknown or other
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccacactcttaatttatgaggtcactaagcggccctnaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaaggcttgcccccc

SEQ ID NO: 541014 - DNA, 485 bp, Homo sapiens
  misc_feature: HIJSMM301AZYP2.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagccc

SEQ ID NO: 541015 - DNA, 479 bp, Homo sapiens; identical to SEQ ID NO: 536050
  misc_feature: HIJSMM301BWXWJ.5.73.G07.1.454.light.4.raw

SEQ ID NO: 541016 - DNA, 515 bp, Homo sapiens
  misc_feature: HIJSMM301A7A2P.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcct

SEQ ID NO: 541017 - DNA, 508 bp, Homo sapiens
  misc_feature: HIJSMM301B4E0K.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccca

SEQ ID NO: 541018 - DNA, 500 bp, Homo sapiens; identical to SEQ ID NO: 536183
  misc_feature: HIJSMM301A9YRW.10.17.B06.1.454.light.4.raw

SEQ ID NO: 541019 - DNA, 522 bp, Homo sapiens
  misc_feature: HIJSMM301B3ZX5.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgttcggcggagggaccaggctgaccgtcctaggtcagcccaaggctgccccctcggtcactctgttcccnccct

SEQ ID NO: 541020 - DNA, 444 bp, Homo sapiens; identical to SEQ ID NO: 535192
  misc_feature: HIJSMM301EXJN3.5.9.A09.1.454.light.4.raw

SEQ ID NO: 541021 - DNA, 492 bp, Homo sapiens; identical to SEQ ID NO: 536010
  misc_feature: HIJSMM301A41GT.10.20.B09.1.454.light.4.raw

SEQ ID NO: 541022 - DNA, 447 bp, Homo sapiens; identical to SEQ ID NO: 535020
  misc_feature: HIJSMM301C6R7W.18.9.A09.1.454.light.4.raw

SEQ ID NO: 541023 - DNA, 497 bp, Homo sapiens; identical to SEQ ID NO: 535286
  misc_feature: HIJSMM301BCUCR.18.59.F04.1.454.light.4.raw

SEQ ID NO: 541024 - DNA, 495 bp, Homo sapiens; identical to SEQ ID NO: 535007
  misc_feature: HIJSMM301ETFLU.22.5.A05.1.454.light.4.raw

SEQ ID NO: 541025 - DNA, 505 bp, Homo sapiens; identical to SEQ ID NO: 535503
  misc_feature: HIJSMM301ENQLO.8.28.C06.1.454.light.4.raw

SEQ ID NO: 541026 - DNA, 486 bp, Homo sapiens
  misc_feature: HIJSMM301ANFXK.49.81.H04.1.454.light.4.raw
agtcgagagacacgaccggtgctcgatttagtagtgtagattcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaataatgataatctaccactcacttcgtcggagggaccgacggtggagatcaaacgaactagtggctgcaccatctgtcttcta

SEQ ID NO: 541027 - DNA, 515 bp, Homo sapiens
  misc_feature: HIJSMM301DW7LH.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccgaggtggaggatgagggtgattactactgttactcaacagacattactactactcatagggtgttcggcggagggaccaagctgaccgtcctaggtcagcccaaggctgccccctcggtcactctgttcccacctcct

SEQ ID NO: 541028 - DNA, 486 bp, Homo sapiens; identical to SEQ ID NO: 535385
  misc_feature: HIJSMM301C6XXV.19.71.G05.1.454.light.4.raw

SEQ ID NO: 541029 - DNA, 441 bp, Homo sapiens; identical to SEQ ID NO: 534971
  misc_feature: HIJSMM301BWBN6.11.3.A03.1.454.light.4.raw

SEQ ID NO: 541030 - DNA, 486 bp, Homo sapiens
  misc_feature: HIJSMM301B3JF5.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggcctcactttcggcggagggaccaaggtggagatcaaacgaactgtggctgcacca

SEQ ID NO: 541031 - DNA, 493 bp, Homo sapiens
  misc_feature: HIJSMM301BJ4GG.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctgggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcgctacgtaga

SEQ ID NO: 541032 - DNA, 489 bp, Homo sapiens; identical to SEQ ID NO: 535386
  misc_feature: HIJSMM301EECB4.12.51.E07.1.454.light.4.raw

SEQ ID NO: 541033 - DNA, 482 bp, Homo sapiens
  misc_feature: HIJSMM301BWWWG.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaa

SEQ ID NO: 541034 - DNA, 416 bp, Homo sapiens; identical to SEQ ID NO: 535308
  misc_feature: HIJSMM301EANU5.16.46.E02.1.454.light.4.raw

SEQ ID NO: 541035 - DNA, 494 bp, Homo sapiens
  misc_feature: HIJSMM301EYC23.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtt

SEQ ID NO: 541036 - DNA, 500 bp, Homo sapiens
  misc_feature: HIJSMM301EB3DZ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctcgccccctcggtcactcttccg

SEQ ID NO: 541037 - DNA, 493 bp, Homo sapiens
  misc_feature: HIJSMM301DGMSY.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 541038 - DNA, 484 bp, Homo sapiens
  misc_feature: HIJSMM301AFXW4.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgcctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagacccg

SEQ ID NO: 541039 - DNA, 484 bp, Homo sapiens
  misc_feature: HIJSMM301B2TZX.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaacgaactgtggctgcaccat

SEQ ID NO: 541040 - DNA, 485 bp, Homo sapiens
  misc_feature: HIJSMM301A5W8P.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgagtccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 541041 - DNA, 516 bp, Homo sapiens
  misc_feature: HIJSMM301EGILI.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacg

SEQ ID NO: 541042 - DNA, 497 bp, Homo sapiens; identical to SEQ ID NO: 535286
  misc_feature: HIJSMM301EPJWF.18.59.F04.1.454.light.4.raw

SEQ ID NO: 541043 - DNA, 444 bp, Homo sapiens; identical to SEQ ID NO: 535027
  misc_feature: HIJSMM301BSLPW.8.73.G07.1.454.light.4.raw

SEQ ID NO: 541044 - DNA, 415 bp, Homo sapiens; identical to SEQ ID NO: 536118
  misc_feature: HIJSMM301D22J1.18.78.H01.1.454.light.4.raw

SEQ ID NO: 541045 - DNA, 447 bp, Homo sapiens; identical to SEQ ID NO: 535201
  misc_feature: HIJSMM301C6X22.18.9.A09.1.454.light.4.raw

SEQ ID NO: 541046 - DNA, 510 bp, Homo sapiens
  misc_feature: HIJSMM301ENBH2.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacaccccctcactttcggcggaggggccaaggtggagatcaagcgaactgtggctgcaccatctgtcttcatcttcccg

SEQ ID NO: 541047 - DNA, 517 bp, Homo sapiens
  misc_feature: HIJSMM301CMH7F.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccgcctcctctctctcg

SEQ ID NO: 541048 - DNA, 487 bp, Homo sapiens; identical to SEQ ID NO: 538190
  misc_feature: HIJSMM301DWP14.47.70.G04.1.454.light.4.raw

SEQ ID NO: 541049 - DNA, 502 bp, Homo sapiens
  misc_feature: HIJSMM301AZH7R.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtcccggggtcctgaccgattcagaggcagcgggtctgggacagatttcactctcaccatcaccaacctgcaggctgaagatgtggcagtttattactgtcagcaatactatagtcctcctctcacgttcggcggaagggaccaaggtggagatcaaacgaactgtggctgcaccatctgtctt

SEQ ID NO: 541050 - DNA, 506 bp, Homo sapiens
  misc_feature: HIJSMM301BVYX0.10.29.C07.1.454.light.4.raw
catagtagtgcacgaccggtgctcgatttagagtgctacgaagggaaaggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaaggctgaggacgaggctgattattactgcagctcatatacaaccagcagcacttctgtattcggcggagggaccaagctgaccgtcctaggtcagcccaaggctcgccccctcggtca

SEQ ID NO: 541051 - DNA, 487 bp, Homo sapiens; identical to SEQ ID NO: 537208
  misc_feature: HIJSMM301BCWBX.3.55.E11.1.454.light.4.raw

SEQ ID NO: 541052 - DNA, 387 bp, Homo sapiens
  misc_feature: HIJSMM301BNIKU.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctggtcactctgttcccaccctctccgagcgacga

SEQ ID NO: 541053 - DNA, 486 bp, Homo sapiens; identical to SEQ ID NO: 537617
  misc_feature: HIJSMM301BF0AA.10.53.E09.1.454.light.4.raw

SEQ ID NO: 541054 - DNA, 504 bp, Homo sapiens; identical to SEQ ID NO: 535561
  misc_feature: HIJSMM301ANQDB.4.57.F02.1.454.light.4.raw

SEQ ID NO: 541055 - DNA, 479 bp, Homo sapiens
  misc_feature: HIJSMM301DIZTU.51.60.F05.1.454.light.4.raw
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcgagggaccaagctgaccgtcctcggtcagcccaaggctcg

SEQ ID NO: 541056 - DNA, 465 bp, Homo sapiens; identical to SEQ ID NO: 538589
  misc_feature: HIJSMM301C4WL5.12.39.D06.1.454.light.4.raw

SEQ ID NO: 541057 - DNA, 454 bp, Homo sapiens; identical to SEQ ID NO: 536347
  misc_feature: HIJSMM301D8ZK4.19.86.H09.1.454.light.4.raw

SEQ ID NO: 541058 - DNA, 493 bp, Homo sapiens
  misc_feature: HIJSMM301BJAEA.52.33.C11.1.454.light.4.raw
cgcagtacgacacgaccggtgctcgatttagagtgagctcgttgggtttgggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcaagcccaaggctgccccccg

SEQ ID NO: 541059 - DNA, 489 bp, Homo sapiens
  misc_feature: HIJSMM301D4JLD.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaacgagccaccctctcctgcagggccagtcagagtgttagcaacaacttagtctggtaccagcagagacctggccaggctcccaggctcctcatctactggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcacccatctgt

SEQ ID NO: 541060 - DNA, 521 bp, Homo sapiens
  misc_feature: HIJSMM301BRT3A.4.57.F02.1.454.light.4.raw
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggagtgaggccgactattactgtcaggtgtgggagtagtagtggtggatcatccatacgtcttcggtaactgggaccgaaggtctccgtcctacgtctagcccaacggccaacccccaacctcgtcactctcgttcccta

SEQ ID NO: 541061 - DNA, 486 bp, Homo sapiens; identical to SEQ ID NO: 537792
  misc_feature: HIJSMM301AJ1EG.46.26.C04.1.454.light.4.raw

SEQ ID NO: 541062 - DNA, 493 bp, Homo sapiens; identical to SEQ ID NO: 540127
  misc_feature: HIJSMM301EAXZV.10.17.B06.1.454.light.4.raw

SEQ ID NO: 541063 - DNA, 484 bp, Homo sapiens
  misc_feature: HIJSMM301B4WPP.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 541064 - DNA, 482 bp, Homo sapiens
  misc_feature: HIJSMM301D0PHO.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagagtaaccctccgtacacttttggccaggggaccaaaggtggagatcaaacgaactgtggctgcacactct

SEQ ID NO: 541065 - DNA, 494 bp, Homo sapiens; identical to SEQ ID NO: 535629
  misc_feature: HIJSMM301BCX42.4.27.C05.1.454.light.4.raw

SEQ ID NO: 541066 - DNA, 489 bp, Homo sapiens
  misc_feature: HIJSMM301EI7EV.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagagtacaacgaa

SEQ ID NO: 541067 - DNA, 488 bp, Homo sapiens
  misc_feature: HIJSMM301AX2WH.48.27.C05.1.454.light.4.raw
agtatacatacacgaccggtgctcgatttagacgcgatcgaagggtttggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaaggaccgaaggtaggaaggtacaaacgaactagtggctgcaccact

SEQ ID NO: 541068 - DNA, 508 bp, Homo sapiens
  misc_feature: HIJSMM301C59QI.17.33.C11.1.454.light.4.raw
cgtagactagcacgaccggtgctcgatttagagtgagctcgttgggtttgggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 541069 - DNA, 454 bp, Homo sapiens; identical to SEQ ID NO: 535005
  misc_feature: HIJSMM301D82D7.19.86.H09.1.454.light.4.raw

SEQ ID NO: 541070 - DNA, 497 bp, Homo sapiens; identical to SEQ ID NO: 535664
  misc_feature: HIJSMM301C7QGC.22.14.B03.1.454.light.4.raw

SEQ ID NO: 541071 - DNA, 488 bp, Homo sapiens
  misc_feature: HIJSMM301BIHPF.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcctacttttggccaggggaccaaagttgagatcaaacgaactgtggctgcaccatctgt

SEQ ID NO: 541072 - DNA, 447 bp, Homo sapiens; identical to SEQ ID NO: 535201
  misc_feature: HIJSMM301EYSL4.18.9.A09.1.454.light.4.raw

SEQ ID NO: 541073 - DNA, 485 bp, Homo sapiens; identical to SEQ ID NO: 536075
  misc_feature: HIJSMM301EQEI7.17.21.B10.1.454.light.4.raw

SEQ ID NO: 541074 - DNA, 328 bp, Homo sapiens
  misc_feature: HIJSMM301EGGYR.8.71.G05.1.454.light.4.raw
ctcgcgtgtccacgaccggtgctcgatttagtgtcgtcgcaagagagaggggggtgaggtgaaagatgagctggaggaccgcaataggggtaggtcccctgtggaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgag

SEQ ID NO: 541075 - DNA, 506 bp, Homo sapiens; identical to SEQ ID NO: 537290
  misc_feature: HIJSMM301DF6Y7.13.11.A11.1.454.light.4.raw

SEQ ID NO: 541076 - DNA, 503 bp, Homo sapiens
  misc_feature: HIJSMM301BS7EA.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccgggatgaggccgactattactgtcaggtgtgggctggtgataatgatcatgcgggggtgttcggcggagggaccaagctgaccgtcctaagtcagcccaaggctgccccctcggtcact

SEQ ID NO: 541077 - DNA, 447 bp, Homo sapiens
  misc_feature: HIJSMM301C05XV.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagctcaaggccaaccctctgtcactctcgttcccgccctcctccatactcgta

SEQ ID NO: 541078 - DNA, 497 bp, Homo sapiens; identical to SEQ ID NO: 535740
  misc_feature: HIJSMM301C4EH9.3.71.G05.1.454.light.4.raw

SEQ ID NO: 541079 - DNA, 490 bp, Homo sapiens; identical to SEQ ID NO: 535936
  misc_feature: HIJSMM301C4TCQ.16.68.G02.1.454.light.4.raw

SEQ ID NO: 541080 - DNA, 484 bp, Homo sapiens
  misc_feature: HIJSMM301EIMRF.49.81.H04.1.454.light.4.raw
agtcgagagacacgaccggtgctcgatttagtagtgtagattcgcgggggagtcagtcccaaccaagacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgt

SEQ ID NO: 541081 - DNA, 478 bp, Homo sapiens
  misc_feature: HIJSMM301CN6TI.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactagtggctgcacca

SEQ ID NO: 541082 - DNA, 454 bp, Homo sapiens; identical to SEQ ID NO: 535005
  misc_feature: HIJSMM301CP7AQ.19.86.H09.1.454.light.4.raw

SEQ ID NO: 541083 - DNA, 484 bp, Homo sapiens; identical to SEQ ID NO: 535240
  misc_feature: HIJSMM301C4CXH.47.60.F05.1.454.light.4.raw

SEQ ID NO: 541084 - DNA, 504 bp, Homo sapiens
  misc_feature: HIJSMM301APDHR.47.64.F09.1.454.light.4.raw
agctcacgtacacgaccggtgctcgatttagcgcgtatacaagggggaggaacgtgctcagttaggacccagagggaaccatggaagccccacgctcagcttctcttcctcctgctactctggctcccagataccatcggagaagttgtgttgacacagtctccagccaccctgtctttgtctccaggggaaagagcccaccctctcctgcagggccagtcagaatattcactcctacttagcctggtaccaacagaaacctggtcaggctcccaggctcctcatctatgatcgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcgtaaacgaactggtggctggcaccatctgtcttcactcc

SEQ ID NO: 541085 - DNA, 506 bp, Homo sapiens
  misc_feature: HIJSMM301CZZ6K.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcact

SEQ ID NO: 541086 - DNA, 497 bp, Homo sapiens; identical to SEQ ID NO: 535740
  misc_feature: HIJSMM301AWA74.3.71.G05.1.454.light.4.raw

SEQ ID NO: 541087 - DNA, 515 bp, Homo sapiens
  misc_feature: HIJSMM301AQKR3.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactacaccttccggtccgaacggaacggaccacgtacggtaggaattaaacgtaaaaccgtgttggcgtcgcaccaactctcgtcttccta

SEQ ID NO: 541088 - DNA, 486 bp, Homo sapiens; identical to SEQ ID NO: 535385
  misc_feature: HIJSMM301EBPCV.19.71.G05.1.454.light.4.raw

SEQ ID NO: 541089 - DNA, 418 bp, Homo sapiens
  misc_feature: HIJSMM301EHYQQ.10.86.H09.1.454.light.4.raw
catagtagtgcacgaccggtgctcgatttagtgctatagacttggggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 541090 - DNA, 522 bp, Homo sapiens
  misc_feature: HIJSMM301DEJB4.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 541091 - DNA, 496 bp, Homo sapiens
  misc_feature: HIJSMM301A612A.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccaggggccaagctggagatcagacgaactgtggctgcaccatctgtcttcatcttccccg

SEQ ID NO: 541092 - DNA, 479 bp, Homo sapiens
  misc_feature: HIJSMM301CVRZM.48.5.A05.1.454.light.4.raw
agtatacatacacgaccggtgctcgatttagatagatagacaggggggaggtcagacccacgtcaggacacagcatggacatgagggtccccgcctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagccctgcagcctgatgattttgcaacttattactgccaacagtattatacttatccatggacgttcggccaggaaccaggtggaatcaaacgaactgtggctgcaccat

SEQ ID NO: 541093 - DNA, 475 bp, Homo sapiens
  misc_feature: HIJSMM301C2PQK.7.81.H04.1.454.light.4.raw
  modified_base (198)..(198): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcnccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 541094 - DNA, 503 bp, Homo sapiens
  misc_feature: HIJSMM301CTOSP.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggagggaccaaaactgaccgtcctaggtcagcccaa

SEQ ID NO: 541095 - DNA, 491 bp, Homo sapiens
  misc_feature: HIJSMM301BRRW6.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccacggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcacccactgtca

SEQ ID NO: 541096 - DNA, 503 bp, Homo sapiens; identical to SEQ ID NO: 535140
  misc_feature: HIJSMM301CYD2Q.18.37.D04.1.454.light.4.raw

SEQ ID NO: 541097 - DNA, 480 bp, Homo sapiens
  misc_feature: HIJSMM301BP4YD.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctggaccaatgtggatatcaaacgaactgtggctgcaccatctgtt

SEQ ID NO: 541098 - DNA, 463 bp, Homo sapiens; identical to SEQ ID NO: 535062
  misc_feature: HIJSMM301AJQT7.11.73.G07.1.454.light.4.raw

SEQ ID NO: 541099 - DNA, 447 bp, Homo sapiens; identical to SEQ ID NO: 535020
  misc_feature: HIJSMM301DTMZ6.18.9.A09.1.454.light.4.raw

SEQ ID NO: 541100 - DNA, 486 bp, Homo sapiens
  misc_feature: HIJSMM301BABSK.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtgggtcccatcaaggttcagtggcgccggatctgggacagaattcactctcaccatcagcgggctccagtctgaggactctgcaacttattactgccaacaatatgatatttattctccagcgttcggccagggaccaaggtggaagtcaagcgaactgtggctgcaccatctgt

SEQ ID NO: 541101 - DNA, 499 bp, Homo sapiens
  misc_feature: HIJSMM301BK6V0.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 541102 - DNA, 470 bp, Homo sapiens
  misc_feature: HIJSMM301A78DF.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggaccgaagtggacatcaacgaa

SEQ ID NO: 541103 - DNA, 513 bp, Homo sapiens
  misc_feature: HIJSMM301AG2SC.15.86.H09.1.454.light.4.raw
tctacgtagccacgaccggtgctcgatttagtgctatagacttgggtttggggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtgggagagagccacacaattgatggccaagacggttgggtgttcgggcggagggaccaagctgaccgtcctaggtcagcccaaggctgccccctcggtcactctcgttcccaccctcctcgctacgt

SEQ ID NO: 541104 - DNA, 516 bp, Homo sapiens
  misc_feature: HIJSMM301APXBN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccgaacgggaccgaaggtaggaaagtacaaacgaaactagttggctgcgaccgactctgtcttctatcttcccg

SEQ ID NO: 541105 - DNA, 479 bp, Homo sapiens
  misc_feature: HIJSMM301C3PGB.41.8.A08.1.454.light.4.raw
tctatactatcacgaccggtgctcgatttagcatactctacagggcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgattttgcaacttactattgtcaacaggctaacagtttcccgatgaccgtcggccaaggacacg

SEQ ID NO: 541106 - DNA, 472 bp, Homo sapiens
  misc_feature: HIJSMM301C73XJ.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtgggtcccatcaagattcagtggcagtggatctgggacagatttcactctcgccatcagtagtctgcaacctgatgattttgcaacttactactgtcaacagagttccactaccccaatcactttcgcctgggactgaatgcatatgaagagaactgtggctgca

SEQ ID NO: 541107 - DNA, 490 bp, Homo sapiens; identical to SEQ ID NO: 537951
  misc_feature: HIJSMM301EJ4X5.19.57.F02.1.454.light.4.raw

SEQ ID NO: 541108 - DNA, 485 bp, Homo sapiens; identical to SEQ ID NO: 536576
  misc_feature: HIJSMM301BEW1V.46.35.D02.1.454.light.4.raw

SEQ ID NO: 541109 - DNA, 444 bp, Homo sapiens; identical to SEQ ID NO: 534993
  misc_feature: HIJSMM301CIJ0L.5.9.A09.1.454.light.4.raw

SEQ ID NO: 541110 - DNA, 494 bp, Homo sapiens; identical to SEQ ID NO: 534992
  misc_feature: HIJSMM301AMU1L.9.1.A01.1.454.light.4.raw

SEQ ID NO: 541111 - DNA, 498 bp, Homo sapiens
  misc_feature: HIJSMM301AKZXP.48.30.C08.1.454.light.4.raw
agtatacatacacgaccggtgctcgatttagtctgacgtcaaagaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggaggattaaacgaactgtggctgcaccatctgtcttcatcttcccg

SEQ ID NO: 541112 - DNA, 454 bp, Homo sapiens; identical to SEQ ID NO: 536449
  misc_feature: HIJSMM301A3LC8.18.78.H01.1.454.light.4.raw

SEQ ID NO: 541113 - DNA, 486 bp, Homo sapiens; identical to SEQ ID NO: 535043
  misc_feature: HIJSMM301CAMD4.46.35.D02.1.454.light.4.raw

SEQ ID NO: 541114 - DNA, 496 bp, Homo sapiens; identical to SEQ ID NO: 540261
  misc_feature: HIJSMM301DW4NH.3.78.H01.1.454.light.4.raw

SEQ ID NO: 541115 - DNA, 483 bp, Homo sapiens
  misc_feature: HIJSMM301CSYOJ.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagct

SEQ ID NO: 541116 - DNA, 504 bp, Homo sapiens
  misc_feature: HIJSMM301B02OA.18.59.F04.1.454.light.4.raw
tacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctgactccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 541117 - DNA, 478 bp, Homo sapiens; identical to SEQ ID NO: 535129
  misc_feature: HIJSMM301ANEV4.11.11.A11.1.454.light.4.raw

SEQ ID NO: 541118 - DNA, 520 bp, Homo sapiens; identical to SEQ ID NO: 535686
  misc_feature: HIJSMM301BKNP4.41.19.B08.1.454.light.4.raw

SEQ ID NO: 541119 - DNA, 514 bp, Homo sapiens
  misc_feature: HIJSMM301C4W10.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtacaccgtcctaggtcagcccaaggccaacccacctgtcactctgttcccgccctccctccgtcgtctgat

SEQ ID NO: 541120 - DNA, 494 bp, Homo sapiens
  misc_feature: HIJSMM301AHCIV.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcccccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaagggcggagatcagacgaactgtggctgcaccatctgtcttcattccc

SEQ ID NO: 541121 - DNA, 528 bp, Homo sapiens
  misc_feature: HIJSMM301A4V3B.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacgggaccgaacggtaggaaggtacgaaacgaaacctagtggcgtgcaccaactctgtcttctactcttcccgtcccactcctgat

SEQ ID NO: 541122 - DNA, 492 bp, Homo sapiens
  misc_feature: HIJSMM301D29OT.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccg

SEQ ID NO: 541123 - DNA, 483 bp, Homo sapiens
  misc_feature: HIJSMM301CN6TY.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgagattttgcaacttactattgtcaacaggctaacagtttcccttaatcttcggccaagggacacgactgagattaaacgaactagtgctgcaccta

SEQ ID NO: 541124 - DNA, 478 bp, Homo sapiens
  misc_feature: HIJSMM301CBFH1.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagattttgttaaggggaaagtaatgaagttaacactgtggatcaccttcggccaagggacacgactggagattaaacgaactgtggctgcaccatctgtcttcactccttcccgccatctgaagtatagtct

SEQ ID NO: 541125 - DNA, 486 bp, Homo sapiens; identical to SEQ ID NO: 536323
  misc_feature: HIJSMM301D2BGM.10.2.A02.1.454.light.4.raw

SEQ ID NO: 541126 - DNA, 472 bp, Homo sapiens; identical to SEQ ID NO: 536302
  misc_feature: HIJSMM301BI5ZH.18.76.G10.1.454.light.4.raw

SEQ ID NO: 541127 - DNA, 491 bp, Homo sapiens
  misc_feature: HIJSMM301EU40H.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttc

SEQ ID NO: 541128 - DNA, 485 bp, Homo sapiens
  misc_feature: HIJSMM301EVLKU.49.61.F06.1.454.light.4.raw
agtcgagagacacgaccggtgctcgatttagctacgctctaagggaagggggaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacc

SEQ ID NO: 541129 - DNA, 490 bp, Homo sapiens
  misc_feature: HIJSMM301BDD0K.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcacatctgtcttcatt

SEQ ID NO: 541130 - DNA, 500 bp, Homo sapiens
  misc_feature: HIJSMM301BVWZP.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagttttattactgtcagcagcgtagcaactggcctccgatcaccttcggccaagggacacgactggagattaaacgaactgtggctgcaccatctgtcttcat

SEQ ID NO: 541131 - DNA, 504 bp, Homo sapiens
  misc_feature: HIJSMM301A2IZ6.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggtccaagggaccaacggtggacgatcaagcgaactgtggctgcaccatctgtcttcatcttcccgtccat

SEQ ID NO: 541132 - DNA, 486 bp, Homo sapiens
  misc_feature: HIJSMM301DHO8O.49.7.A07.1.454.light.4.raw
agtcgagagacacgaccggtgctcgatttagcacgtgtcgcagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggctcctgatctatgctgcatccaatttgcaaagtggggtcccatcaaggttcagtgccagtggatctgggacagacttcaccctcaccatcgacagtctgcaacctgaagattttgcaacttacttctgtcaacagagtttcgcttccccctacacttttggccaggggaccaagctggcgatcaaacgaactgtggctgcaccatctgtcttca

SEQ ID NO: 541133 - DNA, 485 bp, Homo sapiens; identical to SEQ ID NO: 535985
  misc_feature: HIJSMM301B8YD1.15.1.A01.1.454.light.4.raw

SEQ ID NO: 541134 - DNA, 487 bp, Homo sapiens; identical to SEQ ID NO: 536206
  misc_feature: HIJSMM301DP6BL.47.38.D05.1.454.light.4.raw

SEQ ID NO: 541135 - DNA, 497 bp, Homo sapiens; identical to SEQ ID NO: 534982
  misc_feature: HIJSMM301AGLYF.26.80.H03.1.454.light.4.raw

SEQ ID NO: 541136 - DNA, 497 bp, Homo sapiens
  misc_feature: HIJSMM301AYQSK.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtataatagttacccctggacgttcggccaagggaccagggtggaaagtacaaacgaaactgtggctgcaccatctgtcttcatt

SEQ ID NO: 541137 - DNA, 489 bp, Homo sapiens; identical to SEQ ID NO: 536013
  misc_feature: HIJSMM301A7T4P.26.23.C01.1.454.light.4.raw

SEQ ID NO: 541138 - DNA, 488 bp, Homo sapiens
  misc_feature: HIJSMM301B532J.52.53.E09.1.454.light.4.raw
  modified_base (451)..(451): a, c, t, g, unknown or other
cgcagtacgacacgaccggtgctcgatttagagagagtgtgttgggtttggggcagcctcagcagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgagggggacgtatccctgatcgcttctcaggctccggctcgtgggactgagcgctacctcaccatctcacgcctccagtctgaggacgagggtgactattactgtcagacgtgggacactggctagttttggggngttcgggcgggagggacccaaggttcgaccgtccgta

SEQ ID NO: 541139 - DNA, 495 bp, Homo sapiens
  misc_feature: HIJSMM301DAXJR.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccacggtggaaatacaacgaactagtggctgcaccatctgtcttcat

SEQ ID NO: 541140 - DNA, 485 bp, Homo sapiens; identical to SEQ ID NO: 536576
  misc_feature: HIJSMM301D93O4.46.35.D02.1.454.light.4.raw

SEQ ID NO: 541141 - DNA, 490 bp, Homo sapiens
  misc_feature: HIJSMM301CGMP7.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaactgtgg

SEQ ID NO: 541142 - DNA, 475 bp, Homo sapiens
  misc_feature: HIJSMM301DKHGT.40.52.E08.1.454.light.4.raw
tctagcgactcacgaccggtgctcgatttagtcgagctctcagagagaaagggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacattggtgcttataactatgtctcctggtaccaacaacacccaggcgaggcccccaaactcatgatttatgatgtcaataatcggccctcaggggtttctaatcgcttctctggctccaagtctggcaacacggcctccctgaccatctctgggctccaagctgaggacgaggctgtttatttctgcagctcatatacaagcagcaacactctggtgttcggcggagggaccaagctgaccgt

SEQ ID NO: 541143 - DNA, 519 bp, Homo sapiens
  misc_feature: HIJSMM301C98UL.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 541144 - DNA, 503 bp, Homo sapiens
  misc_feature: HIJSMM301ETGPE.49.18.B07.1.454.light.4.raw
agtcgagagacacgaccggtgctcgatttagtcgctgcgtaaaggaggtaaagggggaggaactgctcagttaggacccagagggaaccatggaagccccagctcagcttctcttcctcctgcttctctggctcccagatacttaccggagaaattgtgttgacgcagtctccagccaccctgtctttgtctccaggggaaagagccaccctctcctgcagggccagtcagagtgttaacatctacttagtctggtaccaacagaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttcccg

SEQ ID NO: 541145 - DNA, 488 bp, Homo sapiens; identical to SEQ ID NO: 539884
  misc_feature: HIJSMM301APAUV.7.85.H08.1.454.light.4.raw

SEQ ID NO: 541146 - DNA, 478 bp, Homo sapiens
  misc_feature: HIJSMM301D4HO2.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcggg

SEQ ID NO: 541147 - DNA, 484 bp, Homo sapiens
  misc_feature: HIJSMM301DM3VB.43.4.A04.1.454.light.4.raw
tgtgagtagtcacgaccggtgctcgatttagagtagtgatcaggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcgccaaggaccaaggtggacatcaaacgaactgtggctgcacc

SEQ ID NO: 541148 - DNA, 518 bp, Homo sapiens; identical to SEQ ID NO: 539372
  misc_feature: HIJSMM301ANB1W.7.86.H09.1.454.light.4.raw

SEQ ID NO: 541149 - DNA, 488 bp, Homo sapiens; identical to SEQ ID NO: 535081
  misc_feature: HIJSMM301A0HDZ.26.23.C01.1.454.light.4.raw

SEQ ID NO: 541150 - DNA, 475 bp, Homo sapiens
  misc_feature: HIJSMM301EW5S0.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttctaccatcagcagcctgcagcctgaagatactgcaacatattactgtcaacagtatgataatctgccgctcactttcggtcggagggaccgaaggtaggaggatcaagagaactgtgg

SEQ ID NO: 541151 - DNA, 473 bp, Homo sapiens
  misc_feature: HIJSMM301CLJEG.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcgggggtaccaaggtggacatacaaacgaa

SEQ ID NO: 541152 - DNA, 465 bp, Homo sapiens
  misc_feature: HIJSMM301A5L1C.43.71.G05.1.454.light.4.raw
tgtgagtagtcacgaccggtgctcgatttagtgtcgtcgcaagagagagggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 541153 - DNA, 454 bp, Homo sapiens; identical to SEQ ID NO: 534964
  misc_feature: HIJSMM301CVP5J.19.86.H09.1.454.light.4.raw

SEQ ID NO: 541154 - DNA, 484 bp, Homo sapiens; identical to SEQ ID NO: 535400
  misc_feature: HIJSMM301CTAJK.46.26.C04.1.454.light.4.raw

SEQ ID NO: 541155 - DNA, 508 bp, Homo sapiens
  misc_feature: HIJSMM301EUUBU.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgccttatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgctagtttattattgtcagcagcgtagcaggtggcctttcactttcggcccgggaccaaagtggaaatcaaacgaactgtggctgcaccatctgtcttcatcttcccgcc

SEQ ID NO: 541156 - DNA, 493 bp, Homo sapiens; identical to SEQ ID NO: 535084
  misc_feature: HIJSMM301B4BLM.47.64.F09.1.454.light.4.raw

SEQ ID NO: 541157 - DNA, 469 bp, Homo sapiens
  misc_feature: HIJSMM301ARWPG.51.47.E03.1.454.light.4.raw
cgatcgtatacacgaccggtgctcgatttagactcgcgcacagagagaaggggctgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtc

SEQ ID NO: 541158 - DNA, 485 bp, Homo sapiens
  misc_feature: HIJSMM301DM95L.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactgtggctgcacatctgtt

SEQ ID NO: 541159 - DNA, 494 bp, Homo sapiens
  misc_feature: HIJSMM301AHYE0.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccgccctcctcgctacgtaga

SEQ ID NO: 541160 - DNA, 485 bp, Homo sapiens; identical to SEQ ID NO: 535880
  misc_feature: HIJSMM301DO9IS.7.75.G09.1.454.light.4.raw

SEQ ID NO: 541161 - DNA, 447 bp, Homo sapiens
  misc_feature: HIJSMM301A2USH.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactatcactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 541162 - DNA, 490 bp, Homo sapiens
  misc_feature: HIJSMM301BWN65.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatggcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 541163 - DNA, 486 bp, Homo sapiens
  misc_feature: HIJSMM301C33CK.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccat

SEQ ID NO: 541164 - DNA, 488 bp, Homo sapiens
  misc_feature: HIJSMM301BAKC8.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaactagt

SEQ ID NO: 541165 - DNA, 479 bp, Homo sapiens
  misc_feature: HIJSMM301BR1GY.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctcctggtcatcgctgggctccaggctgacgatgaggctgattattattgccagtcctatgacaacacctgcgtggttttggctgttcggcggcgggacc

SEQ ID NO: 541166 - DNA, 507 bp, Homo sapiens
  misc_feature: HIJSMM301AFY1K.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctcgttcccaccctcctcgctacgtaga

SEQ ID NO: 541167 - DNA, 485 bp, Homo sapiens; identical to SEQ ID NO: 538840
  misc_feature: HIJSMM301ESXJT.19.71.G05.1.454.light.4.raw

SEQ ID NO: 541168 - DNA, 509 bp, Homo sapiens
  misc_feature: HIJSMM301APZMH.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccccg

SEQ ID NO: 541169 - DNA, 503 bp, Homo sapiens
  misc_feature: HIJSMM301BPH7R.21.22.B11.1.454.light.4.raw
  modified_base (409)..(409): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactnttactgtgcatcacgggacgcaacatgggatgacaatctgagcggttgggtgttcggcggagggaccaaactgaccgtcctaggtcagccccaa

SEQ ID NO: 541170 - DNA, 479 bp, Homo sapiens; identical to SEQ ID NO: 535665
  misc_feature: HIJSMM301DAZSQ.12.10.A10.1.454.light.4.raw

SEQ ID NO: 541171 - DNA, 492 bp, Homo sapiens; identical to SEQ ID NO: 536010
  misc_feature: HIJSMM301CO62Z.10.20.B09.1.454.light.4.raw

SEQ ID NO: 541172 - DNA, 498 bp, Homo sapiens
  misc_feature: HIJSMM301BR7MR.10.65.F10.1.454.light.4.raw
catagtagtgcacgaccggtgctcgatttagctacgctctaaggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttccccg

SEQ ID NO: 541173 - DNA, 479 bp, Homo sapiens
  misc_feature: HIJSMM301ECUMU.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaaatcacttcgccctggacgtgaagtgcataatgaagagaaactagtggcgtgca

SEQ ID NO: 541174 - DNA, 471 bp, Homo sapiens
  misc_feature: HIJSMM301EELQR.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctggacgttcggccaagggaccaaggtggaaatcaaacgaa

SEQ ID NO: 541175 - DNA, 484 bp, Homo sapiens; identical to SEQ ID NO: 535400
  misc_feature: HIJSMM301BOKCW.46.26.C04.1.454.light.4.raw

SEQ ID NO: 541176 - DNA, 492 bp, Homo sapiens
  misc_feature: HIJSMM301EAFIT.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggcggagatcagacgaacctgtggctgcaccatctgtcttcta

SEQ ID NO: 541177 - DNA, 497 bp, Homo sapiens; identical to SEQ ID NO: 535740
  misc_feature: HIJSMM301CF770.3.71.G05.1.454.light.4.raw

SEQ ID NO: 541178 - DNA, 486 bp, Homo sapiens; identical to SEQ ID NO: 535043
  misc_feature: HIJSMM301BA96X.46.35.D02.1.454.light.4.raw

SEQ ID NO: 541179 - DNA, 516 bp, Homo sapiens
  misc_feature: HIJSMM301D54S4.52.53.E09.1.454.light.4.raw
cgcagtacgacacgaccggtgctcgatttagagagagtgtgttgggtttggggcgtggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcattttgtaggcactaagcggccctcaggggtccctgatcgcttctctggctcgaagtctggcaacacggcctccctgacgtctctgggctccaggctgaggatgaggctgattactactgcacctcatatgcaggcgacaacaattttgggggttttcggcggagggaccgaagtgaccgtcctacgtcagcccaaggctcgccccctccggtcact

SEQ ID NO: 541180 - DNA, 495 bp, Homo sapiens
  misc_feature: HIJSMM301EOCCH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaagtcaaacgaactgtggctgcaccatctgtcttca

SEQ ID NO: 541181 - DNA, 513 bp, Homo sapiens
  misc_feature: HIJSMM301EQGYR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaccgaaggtaggaaagtacaaacgaaactagtggctgcaccactctgtcttctatcttccccg

SEQ ID NO: 541182 - DNA, 444 bp, Homo sapiens; identical to SEQ ID NO: 534993
  misc_feature: HIJSMM301ANK8C.5.9.A09.1.454.light.4.raw

SEQ ID NO: 541183 - DNA, 494 bp, Homo sapiens
  misc_feature: HIJSMM301BJLBE.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 541184 - DNA, 502 bp, Homo sapiens
  misc_feature: HIJSMM301CCXKM.21.81.H04.1.454.light.4.raw
  modified_base (496)..(496): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccnctgtca

SEQ ID NO: 541185 - DNA, 507 bp, Homo sapiens
  misc_feature: HIJSMM301C52AH.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggttcgccccctcggtcactctccg

SEQ ID NO: 541186 - DNA, 504 bp, Homo sapiens
  misc_feature: HIJSMM301B4YEX.8.28.C06.1.454.light.4.raw
  modified_base (296)..(296): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggngcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgc

SEQ ID NO: 541187 - DNA, 487 bp, Homo sapiens
  misc_feature: HIJSMM301ER6UK.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 541188 - DNA, 503 bp, Homo sapiens
  misc_feature: HIJSMM301CE5BZ.15.86.H09.1.454.light.4.raw
tctacgtagccacgaccggtgctcgatttagtgctatagacttgggtttgggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctcctcg

SEQ ID NO: 541189 - DNA, 488 bp, Homo sapiens
  misc_feature: HIJSMM301DZARV.14.55.E11.1.454.light.4.raw
  modified_base (427)..(427): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctcaaggttcagtggcagtggatctgggaacagatttcactctcaccgtcagcagtctgcaacctgaagattttgcaacttactactgtcaacagagttacagtacccccctnactttcggcggaggaccaaggcggagatcagacgaactgtggctgcaccatctgtcttcta

SEQ ID NO: 541190 - DNA, 447 bp, Homo sapiens; identical to SEQ ID NO: 535201
  misc_feature: HIJSMM301CWFJ7.18.9.A09.1.454.light.4.raw

SEQ ID NO: 541191 - DNA, 494 bp, Homo sapiens; identical to SEQ ID NO: 534994
  misc_feature: HIJSMM301EWUSF.27.78.H01.1.454.light.4.raw

SEQ ID NO: 541192 - DNA, 496 bp, Homo sapiens; identical to SEQ ID NO: 538625
  misc_feature: HIJSMM301DTLKK.2.49.E05.1.454.light.4.raw

SEQ ID NO: 541193 - DNA, 486 bp, Homo sapiens
  misc_feature: HIJSMM301CQW0Z.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccccggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaact

SEQ ID NO: 541194 - DNA, 504 bp, Homo sapiens
  misc_feature: HIJSMM301C7ZBN.27.78.H01.1.454.light.4.raw
  modified_base (431)..(431): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcaccttcggccaagggacacgactggagattaaaacg

SEQ ID NO: 541195 - DNA, 488 bp, Homo sapiens
  misc_feature: HIJSMM301C6819.52.53.E09.1.454.light.4.raw
  modified_base (396)..(396): a, c, t, g, unknown or other
cgcagtacgacacgaccggtgctcgatttagagagagtgtgttgggtttggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctggtacttgatgaggctcaacagtgatggcagccacagcaggggggacgtatccctgatcgcttctcaggctccggctctgggactgagcgctacctcaccatctccagcctccagtctgaggacgagggtnactattactgtcagacgtgggacactggcatttggggtgttcggcggagggaccaagttgaccgtcctaggtcagcccaaggctgccccccg

SEQ ID NO: 541196 - DNA, 486 bp, Homo sapiens; identical to SEQ ID NO: 535043
  misc_feature: HIJSMM301AH7UE.46.35.D02.1.454.light.4.raw

SEQ ID NO: 541197 - DNA, 488 bp, Homo sapiens; identical to SEQ ID NO: 536861
  misc_feature: HIJSMM301BCAE2.12.88.H11.1.454.light.4.raw

SEQ ID NO: 541198 - DNA, 512 bp, Homo sapiens
  misc_feature: HIJSMM301AKRFB.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattagagatcaaacgaactgtggctgcaccatctgtcttcatcttcccgacc

SEQ ID NO: 541199 - DNA, 496 bp, Homo sapiens; identical to SEQ ID NO: 535109
  misc_feature: HIJSMM301ESEPH.16.78.H01.1.454.light.4.raw

SEQ ID NO: 541200 - DNA, 488 bp, Homo sapiens; identical to SEQ ID NO: 537260
  misc_feature: HIJSMM301CQFAU.47.70.G04.1.454.light.4.raw

SEQ ID NO: 541201 - DNA, 510 bp, Homo sapiens
  misc_feature: HIJSMM301DK7Z5.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcgtcgactctgtt

SEQ ID NO: 541202 - DNA, 481 bp, Homo sapiens; identical to SEQ ID NO: 535993
  misc_feature: HIJSMM301AXIR7.21.25.C03.1.454.light.4.raw

SEQ ID NO: 541203 - DNA, 491 bp, Homo sapiens
  misc_feature: HIJSMM301A7JLM.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggcgcgcgttttcggcgggggacgaagtggacatcaaacgaactgtggcgtgcgaccactctcgtt

SEQ ID NO: 541204 - DNA, 503 bp, Homo sapiens
  misc_feature: HIJSMM301COZSQ.2.71.G05.1.454.light.4.raw
acgctcgacacacgaccggtgctcgatttagtgtcgtcgcaagagagagggggctcagaagcagagttctgggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 541205 - DNA, 490 bp, Homo sapiens; identical to SEQ ID NO: 536855
  misc_feature: HIJSMM301BALFL.16.68.G02.1.454.light.4.raw

SEQ ID NO: 541206 - DNA, 447 bp, Homo sapiens; identical to SEQ ID NO: 535201
  misc_feature: HIJSMM301CY3VS.18.9.A09.1.454.light.4.raw

SEQ ID NO: 541207 - DNA, 465 bp, Homo sapiens
  misc_feature: HIJSMM301CKPTR.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggtcggagggaccaaggtggagatcaagagaa

SEQ ID NO: 541208 - DNA, 440 bp, Homo sapiens
  misc_feature: HIJSMM301DVENB.41.9.A09.1.454.light.4.raw
tctatactatcacgaccggtgctcgatttagcgagacgcgcagggtcctgggcccagtctgtcctgactcagccaccctcagcgtctgggacccccggcagacggtgaccgtctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtataga

SEQ ID NO: 541209 - DNA, 489 bp, Homo sapiens
  misc_feature: HIJSMM301DHEJI.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagccggagatcaaacgaactgtggctgcaccatctgt

SEQ ID NO: 541210 - DNA, 489 bp, Homo sapiens
  misc_feature: HIJSMM301C9VKT.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaaacgaactgtggctgcaccatctgtt

SEQ ID NO: 541211 - DNA, 516 bp, Homo sapiens
  misc_feature: HIJSMM301AECHS.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttccgcctcctccacg

SEQ ID NO: 541212 - DNA, 447 bp, Homo sapiens
  misc_feature: HIJSMM301DJQR2.52.75.G09.1.454.light.4.raw
cgcagtacgacacgaccggtgctcgatttagtatagacatcagggggctggggtctcaggaggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattgggatttctcatcgcttctctggctccaagtctggcaacacggcctccctcaccatctctgggctcctgactgaggacgaggctgattattactgcagctcatttacaagcaccaccactcctgtaatcttcggcggagggaccaagctgaccgtcctaggtcagcccaaggctgccccctcggtcactctgttcccgccctcctctatacgatcg

SEQ ID NO: 541213 - DNA, 444 bp, Homo sapiens; identical to SEQ ID NO: 535192
  misc_feature: HIJSMM301B8SMI.5.9.A09.1.454.light.4.raw

SEQ ID NO: 541214 - DNA, 478 bp, Homo sapiens; identical to SEQ ID NO: 535129
  misc_feature: HIJSMM301BCTL1.11.11.A11.1.454.light.4.raw

SEQ ID NO: 541215 - DNA, 473 bp, Homo sapiens
  misc_feature: HIJSMM301DWEXU.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaa

SEQ ID NO: 541216 - DNA, 484 bp, Homo sapiens; identical to SEQ ID NO: 537891
  misc_feature: HIJSMM301BN9SC.10.1.A01.1.454.light.4.raw

SEQ ID NO: 541217 - DNA, 486 bp, Homo sapiens; identical to SEQ ID NO: 535054
  misc_feature: HIJSMM301CXXT6.47.70.G04.1.454.light.4.raw

SEQ ID NO: 541218 - DNA, 512 bp, Homo sapiens; identical to SEQ ID NO: 539198
  misc_feature: HIJSMM301CSTO9.17.33.C11.1.454.light.4.raw

SEQ ID NO: 541219 - DNA, 485 bp, Homo sapiens; identical to SEQ ID NO: 535822
  misc_feature: HIJSMM301C9U4V.14.53.E09.1.454.light.4.raw

SEQ ID NO: 541220 - DNA, 491 bp, Homo sapiens
  misc_feature: HIJSMM301BDL1J.10.77.G11.1.454.light.4.raw
catagtagtgcacgaccggtgctcgatttagctagtcactcaagggaaaggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaaggaccgaaacgtaggacatcaagcgaactagtggctgcaccactct

SEQ ID NO: 541221 - DNA, 474 bp, Homo sapiens
  misc_feature: HIJSMM301DZWV8.12.49.E05.1.454.light.4.raw
  modified_base (438)..(438): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttnaccttcggccaagggacacgactggagattagaacg

SEQ ID NO: 541222 - DNA, 496 bp, Homo sapiens; identical to SEQ ID NO: 535109
  misc_feature: HIJSMM301EC419.16.78.H01.1.454.light.4.raw

SEQ ID NO: 541223 - DNA, 479 bp, Homo sapiens; identical to SEQ ID NO: 535586
  misc_feature: HIJSMM301C9NCC.13.34.D01.1.454.light.4.raw

SEQ ID NO: 541224 - DNA, 494 bp, Homo sapiens; identical to SEQ ID NO: 534994
  misc_feature: HIJSMM301BZXKE.27.78.H01.1.454.light.4.raw

SEQ ID NO: 541225 - DNA, 499 bp, Homo sapiens; identical to SEQ ID NO: 537800
  misc_feature: HIJSMM301EGFYN.22.38.D05.1.454.light.4.raw

SEQ ID NO: 541226 - DNA, 493 bp, Homo sapiens; identical to SEQ ID NO: 539456
  misc_feature: HIJSMM301DO4L9.10.79.H02.1.454.light.4.raw

SEQ ID NO: 541227 - DNA, 486 bp, Homo sapiens
  misc_feature: HIJSMM301EUDGH.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccacggctatggatgaggctgactattaactgtcaggcgtgggacgatcagcagtgaggtgggttttcggtcggagggacccgaagctgaccgtcctaagtcagccccg

SEQ ID NO: 541228 - DNA, 500 bp, Homo sapiens
  misc_feature: HIJSMM301B2G5R.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcactctgtt

SEQ ID NO: 541229 - DNA, 486 bp, Homo sapiens; identical to SEQ ID NO: 535385
  misc_feature: HIJSMM301EADVX.19.71.G05.1.454.light.4.raw

SEQ ID NO: 541230 - DNA, 421 bp, Homo sapiens
  misc_feature: HIJSMM301C3G1S.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcgggtcgaagccggggatgaggccgactatttctgtcagctgtgggattctcatgatggtagtgggggaatcttcggcggagggaccaggctgaccgtcctaagtcagcccaaggctgcccctcggtcactctgttcccaccctcctcagacgtatca

SEQ ID NO: 541231 - DNA, 487 bp, Homo sapiens; identical to SEQ ID NO: 537220
  misc_feature: HIJSMM301AYPIX.16.53.E09.1.454.light.4.raw

SEQ ID NO: 541232 - DNA, 486 bp, Homo sapiens; identical to SEQ ID NO: 537127
  misc_feature: HIJSMM301EUM6Z.3.77.G11.1.454.light.4.raw

SEQ ID NO: 541233 - DNA, 472 bp, Homo sapiens; identical to SEQ ID NO: 536302
  misc_feature: HIJSMM301AGGV1.18.76.G10.1.454.light.4.raw

SEQ ID NO: 541234 - DNA, 447 bp, Homo sapiens; identical to SEQ ID NO: 535020
  misc_feature: HIJSMM301CJU0P.18.9.A09.1.454.light.4.raw

SEQ ID NO: 541235 - DNA, 496 bp, Homo sapiens
  misc_feature: HIJSMM301AY66X.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatacaaacgaactgtggctgcaccatctgtctt

SEQ ID NO: 541236 - DNA, 479 bp, Homo sapiens; identical to SEQ ID NO: 537163
  misc_feature: HIJSMM301C9V11.13.73.G07.1.454.light.4.raw

SEQ ID NO: 541237 - DNA, 446 bp, Homo sapiens
  misc_feature: HIJSMM301ANBXG.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgcccctcctctacgtgagct

SEQ ID NO: 541238 - DNA, 509 bp, Homo sapiens; identical to SEQ ID NO: 541168
  misc_feature: HIJSMM301DTVAY.5.60.F05.1.454.light.4.raw

SEQ ID NO: 541239 - DNA, 484 bp, Homo sapiens; identical to SEQ ID NO: 537878
  misc_feature: HIJSMM301D5TGN.17.34.D01.1.454.light.4.raw

SEQ ID NO: 541240 - DNA, 488 bp, Homo sapiens; identical to SEQ ID NO: 535081
  misc_feature: HIJSMM301AJF0U.26.23.C01.1.454.light.4.raw

SEQ ID NO: 541241 - DNA, 508 bp, Homo sapiens; identical to SEQ ID NO: 536388
  misc_feature: HIJSMM301C5P1F.11.57.F02.1.454.light.4.raw

SEQ ID NO: 541242 - DNA, 494 bp, Homo sapiens
  misc_feature: HIJSMM301CPGG0.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagacaaacgaactgtggctgcaccatctgtcttcatt

SEQ ID NO: 541243 - DNA, 494 bp, Homo sapiens; identical to SEQ ID NO: 535276
  misc_feature: HIJSMM301A3I04.16.6.A06.1.454.light.4.raw

SEQ ID NO: 541244 - DNA, 490 bp, Homo sapiens
  misc_feature: HIJSMM301BMPED.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaaggctcg

SEQ ID NO: 541245 - DNA, 444 bp, Homo sapiens; identical to SEQ ID NO: 534993
  misc_feature: HIJSMM301DT2LZ.5.9.A09.1.454.light.4.raw

SEQ ID NO: 541246 - DNA, 488 bp, Homo sapiens
  misc_feature: HIJSMM301DMJGM.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctatctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaagaactgtggctgcacatctgtcttcatt

SEQ ID NO: 541247 - DNA, 499 bp, Homo sapiens
  misc_feature: HIJSMM301EZ9BH.15.83.H06.1.454.light.4.raw
tctacgtagccacgaccggtgctcgatttagatcacgtgcgtcgcggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggtccaacgggaccaaggtaggacgatcaaacgaactacgtggcgtgcaccactctgtcttt

SEQ ID NO: 541248 - DNA, 492 bp, Homo sapiens
  misc_feature: HIJSMM301B5C9E.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatacaaacgaactgtggct

SEQ ID NO: 541249 - DNA, 472 bp, Homo sapiens
  misc_feature: HIJSMM301DBKCN.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtgg

SEQ ID NO: 541250 - DNA, 489 bp, Homo sapiens; identical to SEQ ID NO: 535402
  misc_feature: HIJSMM301BOZMY.11.12.B01.1.454.light.4.raw

SEQ ID NO: 541251 - DNA, 494 bp, Homo sapiens; identical to SEQ ID NO: 535184
  misc_feature: HIJSMM301BQVMF.16.71.G05.1.454.light.4.raw

SEQ ID NO: 541252 - DNA, 504 bp, Homo sapiens
  misc_feature: HIJSMM301BSXW1.8.33.C11.1.454.light.4.raw
ctcgcgtgtccacgaccggtgctcgatttagagtgagctcgttgggtttgggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaagtggatatcaaacgaactgtggctgcaccatctgtcttcat

SEQ ID NO: 541253 - DNA, 488 bp, Homo sapiens; identical to SEQ ID NO: 537124
  misc_feature: HIJSMM301APV9F.11.25.C03.1.454.light.4.raw

SEQ ID NO: 541254 - DNA, 501 bp, Homo sapiens; identical to SEQ ID NO: 536818
  misc_feature: HIJSMM301BHN03.12.82.H05.1.454.light.4.raw

SEQ ID NO: 541255 - DNA, 506 bp, Homo sapiens
  misc_feature: HIJSMM301D8R9J.10.71.G05.1.454.light.4.raw
catagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaataagaggtcaaacgaaactgtggctgcaccat

SEQ ID NO: 541256 - DNA, 503 bp, Homo sapiens
  misc_feature: HIJSMM301CJ6NV.18.23.C01.1.454.light.4.raw
tacgagtatgcacgaccggtgctcgatttagtacacgtgattagggattgggggagtcagacccacgtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttccccg

SEQ ID NO: 541257 - DNA, 493 bp, Homo sapiens; identical to SEQ ID NO: 535084
  misc_feature: HIJSMM301DAJTI.47.64.F09.1.454.light.4.raw

SEQ ID NO: 541258 - DNA, 491 bp, Homo sapiens
  misc_feature: HIJSMM301DJ4T3.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctacacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccctc

SEQ ID NO: 541259 - DNA, 491 bp, Homo sapiens
  misc_feature: HIJSMM301E3L4I.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccccactgtcactctgttcccaccctcctctacgtgagct

SEQ ID NO: 541260 - DNA, 505 bp, Homo sapiens
  misc_feature: HIJSMM301AEDUH.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaacgggaccgaacggtaggaaagtacaaacgaactagtggctgcaccatact

SEQ ID NO: 541261 - DNA, 505 bp, Homo sapiens
  misc_feature: HIJSMM301BU6XE.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccaccctcctccgtct

SEQ ID NO: 541262 - DNA, 499 bp, Homo sapiens
  misc_feature: HIJSMM301BMJIX.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggaggtccaggcagaggacgaggctgactattattgtcaatcaacagacaccattggtacttatgtcttcggaactgcgaccaaggtcaccgtcctgggtcagcccaaggccaacccccactgtcactcttcg

SEQ ID NO: 541263 - DNA, 494 bp, Homo sapiens; identical to SEQ ID NO: 534994
  misc_feature: HIJSMM301EUYA3.27.78.H01.1.454.light.4.raw

SEQ ID NO: 541264 - DNA, 501 bp, Homo sapiens
  misc_feature: HIJSMM301BA9C3.16.49.E05.1.454.light.4.raw
tgtactactccacgaccggtgctcgatttagagcgactagcaacacacaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgcccccc

SEQ ID NO: 541265 - DNA, 415 bp, Homo sapiens; identical to SEQ ID NO: 535434
  misc_feature: HIJSMM301AN2IR.16.46.E02.1.454.light.4.raw

SEQ ID NO: 541266 - DNA, 482 bp, Homo sapiens; identical to SEQ ID NO: 535216
  misc_feature: HIJSMM301A6HR2.17.26.C04.1.454.light.4.raw

SEQ ID NO: 541267 - DNA, 479 bp, Homo sapiens
  misc_feature: HIJSMM301A3S8J.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatcccaggatgacccagtcgtccagtcctcccgtgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctcccatacacttttggccaggggaccaagctggagatcagaacg

SEQ ID NO: 541268 - DNA, 483 bp, Homo sapiens
  misc_feature: HIJSMM301CGBLW.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcggggggaccgaagtggacgtcaacgaactgtggctgcacc

SEQ ID NO: 541269 - DNA, 461 bp, Homo sapiens
  misc_feature: HIJSMM301BZHFM.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaagtggagatcaacgaactgtggctgcaccatctgtcttcatcttcccgccatctgacactactatg

SEQ ID NO: 541270 - DNA, 483 bp, Homo sapiens; identical to SEQ ID NO: 535317
  misc_feature: HIJSMM301CCZF6.4.1.A01.1.454.light.4.raw

SEQ ID NO: 541271 - DNA, 530 bp, Homo sapiens
  misc_feature: HIJSMM301CYUWB.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggtcgggggaccggaacgacgtgaccggtacccttacggttcgacgacccgaaaccggacgtcgccccccgtccccggtcgtaacct

SEQ ID NO: 541272 - DNA, 490 bp, Homo sapiens
  misc_feature: HIJSMM301D93NE.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagccagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgt

SEQ ID NO: 541273 - DNA, 494 bp, Homo sapiens; identical to SEQ ID NO: 534992
  misc_feature: HIJSMM301DD6GB.9.1.A01.1.454.light.4.raw

SEQ ID NO: 541274 - DNA, 476 bp, Homo sapiens; identical to SEQ ID NO: 538026
  misc_feature: HIJSMM301BMUYC.13.76.G10.1.454.light.4.raw

SEQ ID NO: 541275 - DNA, 494 bp, Homo sapiens; identical to SEQ ID NO: 539922
  misc_feature: HIJSMM301CTD8V.27.78.H01.1.454.light.4.raw

SEQ ID NO: 541276 - DNA, 444 bp, Homo sapiens; identical to SEQ ID NO: 536484
  misc_feature: HIJSMM301ALQZG.8.11.A11.1.454.light.4.raw

SEQ ID NO: 541277 - DNA, 463 bp, Homo sapiens; identical to SEQ ID NO: 535062
  misc_feature: HIJSMM301EKZSI.11.73.G07.1.454.light.4.raw

SEQ ID NO: 541278 - DNA, 497 bp, Homo sapiens; identical to SEQ ID NO: 535664
  misc_feature: HIJSMM301EID0M.22.14.B03.1.454.light.4.raw

SEQ ID NO: 541279 - DNA, 502 bp, Homo sapiens
  misc_feature: HIJSMM301AT2GF.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgtcggccgaagggaccgaaggtggaatacaaacgaactagtggctgcaccatctgtcttctatcttccccg

SEQ ID NO: 541280 - DNA, 496 bp, Homo sapiens; identical to SEQ ID NO: 535541
  misc_feature: HIJSMM301DBQ60.3.33.C11.1.454.light.4.raw

SEQ ID NO: 541281 - DNA, 497 bp, Homo sapiens
  misc_feature: HIJSMM301AKU78.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcaacagactggagtctgaagattttgcagtgtattattgtcagcaatatggtaggtcacctgggacttttggccaggggaccaagctggagatcaaacgaactgtggctgcaccatctgtcttca

SEQ ID NO: 541282 - DNA, 521 bp, Homo sapiens
  misc_feature: HIJSMM301B2C0O.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagtgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtcg

SEQ ID NO: 541283 - DNA, 495 bp, Homo sapiens; identical to SEQ ID NO: 538359
  misc_feature: HIJSMM301D7G5L.11.59.F04.1.454.light.4.raw

SEQ ID NO: 541284 - DNA, 493 bp, Homo sapiens; identical to SEQ ID NO: 540880
  misc_feature: HIJSMM301EWWB8.40.81.H04.1.454.light.4.raw

SEQ ID NO: 541285 - DNA, 487 bp, Homo sapiens
  misc_feature: HIJSMM301EH75Y.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcgcggaggaccgaaggtggagatcaagacgaactgtggctgcaccat

SEQ ID NO: 541286 - DNA, 453 bp, Homo sapiens; identical to SEQ ID NO: 535650
  misc_feature: HIJSMM301ET1OA.19.86.H09.1.454.light.4.raw

SEQ ID NO: 541287 - DNA, 506 bp, Homo sapiens
  misc_feature: HIJSMM301BKLMJ.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 541288 - DNA, 488 bp, Homo sapiens; identical to SEQ ID NO: 535861
  misc_feature: HIJSMM301CXW4W.14.55.E11.1.454.light.4.raw

SEQ ID NO: 541289 - DNA, 519 bp, Homo sapiens
  misc_feature: HIJSMM301BVQ7B.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 541290 - DNA, 504 bp, Homo sapiens; identical to SEQ ID NO: 535561
  misc_feature: HIJSMM301AK12J.4.57.F02.1.454.light.4.raw

SEQ ID NO: 541291 - DNA, 444 bp, Homo sapiens; identical to SEQ ID NO: 534993
  misc_feature: HIJSMM301AV3T0.5.9.A09.1.454.light.4.raw

SEQ ID NO: 541292 - DNA, 512 bp, Homo sapiens
  misc_feature: HIJSMM301C3SF2.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctctttggtcgtctatgatgatcgcgaccggcccgcaggggtccctgaacgattctctggcgccagctctcagaacacggccaccctgatcatcaacagggtcgaagtcgggatgaggccgactattactgtcaggtctgggatactgaaattgaatatgtcttcggaactgggaccaaagtcaccgtcctaggtcagcccaaggccaaccccactgtcactctgttcccgccctcct

SEQ ID NO: 541293 - DNA, 487 bp, Homo sapiens
  misc_feature: HIJSMM301AJ9TD.5.48.E04.1.454.light.4.raw
atcagacacgcacgaccggtgctcgatttagagagcgtcacagagagaaggggagagggaaccatggaaaccccagcgcagcttctcttcctcctgctactctggctcccagattctgtcggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgcacctttcactttcggcggagggaccaaggtggagagcagacgaactgtggctgcaccatctgtcttcatcttcccgccat

SEQ ID NO: 541294 - DNA, 501 bp, Homo sapiens; identical to SEQ ID NO: 535746
  misc_feature: HIJSMM301CRODF.18.11.A11.1.454.light.4.raw

SEQ ID NO: 541295 - DNA, 488 bp, Homo sapiens
  misc_feature: HIJSMM301D7ZZC.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccat

SEQ ID NO: 541296 - DNA, 494 bp, Homo sapiens; identical to SEQ ID NO: 534992
  misc_feature: HIJSMM301C6BQX.9.1.A01.1.454.light.4.raw

SEQ ID NO: 541297 - DNA, 485 bp, Homo sapiens
  misc_feature: HIJSMM301DYFPN.49.60.F05.1.454.light.4.raw
agtcgagagacacgaccggtgctcgatttagtacgtcatcagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggaggaccaaggtggagatcaaaacg

SEQ ID NO: 541298 - DNA, 464 bp, Homo sapiens
  misc_feature: HIJSMM301BNXID.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggatgaccgtcctaagtcagcccaaggctgccccctcggtcactctgttcccaccctcctcctagtctacg

SEQ ID NO: 541299 - DNA, 383 bp, Homo sapiens; identical to SEQ ID NO: 447524
  misc_feature: HIJSMM301AXKSN.41.26.C04.1.454.light.4.raw

SEQ ID NO: 541300 - DNA, 512 bp, Homo sapiens
  misc_feature: HIJSMM301B4K7H.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 541301 - DNA, 467 bp, Homo sapiens
  misc_feature: HIJSMM301BWU6N.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagatgacagcacgcctcacactttcggcggtagggaccgaaggtggagatcaaacgaa

SEQ ID NO: 541302 - DNA, 486 bp, Homo sapiens; identical to SEQ ID NO: 535290
  misc_feature: HIJSMM301AUAHG.3.12.B01.1.454.light.4.raw

SEQ ID NO: 541303 - DNA, 497 bp, Homo sapiens; identical to SEQ ID NO: 536371
  misc_feature: HIJSMM301ATD21.16.78.H01.1.454.light.4.raw

SEQ ID NO: 541304 - DNA, 502 bp, Homo sapiens; identical to SEQ ID NO: 536253
  misc_feature: HIJSMM301AM55Z.21.22.B11.1.454.light.4.raw

SEQ ID NO: 541305 - DNA, 464 bp, Homo sapiens
  misc_feature: HIJSMM301A6AOF.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccaccctcctccacgagagta

SEQ ID NO: 541306 - DNA, 484 bp, Homo sapiens
  misc_feature: HIJSMM301CYO3J.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcgagggaccagggtggagatcaaaacg

SEQ ID NO: 541307 - DNA, 487 bp, Homo sapiens
  misc_feature: HIJSMM301EIR84.19.71.G05.1.454.light.4.raw
tactctcgtgcacgaccggtgctcgatttagtgtcgtcgcaagagagagggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 541308 - DNA, 505 bp, Homo sapiens
  misc_feature: HIJSMM301A36L2.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaataagaggtcaaacgaaactgtggctgcaccatctgtcttcat

SEQ ID NO: 541309 - DNA, 478 bp, Homo sapiens; identical to SEQ ID NO: 535129
  misc_feature: HIJSMM301EMETR.11.11.A11.1.454.light.4.raw

SEQ ID NO: 541310 - DNA, 485 bp, Homo sapiens; identical to SEQ ID NO: 536040
  misc_feature: HIJSMM301DH6RL.15.1.A01.1.454.light.4.raw

SEQ ID NO: 541311 - DNA, 521 bp, Homo sapiens
  misc_feature: HIJSMM301BPKZS.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcctccgtcg

SEQ ID NO: 541312 - DNA, 513 bp, Homo sapiens
  misc_feature: HIJSMM301BTSMG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaccgaaggtaggaaagtacaaacgaactagtggcgtgcaccatctgtcttctactcttccccg

SEQ ID NO: 541313 - DNA, 492 bp, Homo sapiens
  misc_feature: HIJSMM301A1YQD.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcatcttcccg

SEQ ID NO: 541314 - DNA, 448 bp, Homo sapiens; identical to SEQ ID NO: 540364
  misc_feature: HIJSMM301C0SS8.18.9.A09.1.454.light.4.raw

SEQ ID NO: 541315 - DNA, 492 bp, Homo sapiens; identical to SEQ ID NO: 536010
  misc_feature: HIJSMM301CPH24.10.20.B09.1.454.light.4.raw

SEQ ID NO: 541316 - DNA, 503 bp, Homo sapiens
  misc_feature: HIJSMM301DRZA5.43.38.D05.1.454.light.4.raw
tgtgagtagtcacgaccggtgctcgatttagtatctgatagttgggtttggggaggtcagacccacgtcaggacacagcctggacatgagggtccccgcctcagctcctggggcgtcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaagcccctaaactcctgatctttgaggcatctcgtttagaaagtgggtccctcaaggttcagcggcagtgcatctgggacagatttcactctcaccatcagcagcctgcagcctgatgattttgcaacttattactgtcaacagtataatagttaccccctggacgttcgccaagggaccgagggtggaaatcaaacgaactgtggctgcaccatctgtcttcatcttccccg

SEQ ID NO: 541317 - DNA, 445 bp, Homo sapiens
  misc_feature: HIJSMM301C042S.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttccctccctcctccgtcgtctgat

SEQ ID NO: 541318 - DNA, 486 bp, Homo sapiens; identical to SEQ ID NO: 535043
  misc_feature: HIJSMM301CJE0B.46.35.D02.1.454.light.4.raw

SEQ ID NO: 541319 - DNA, 504 bp, Homo sapiens; identical to SEQ ID NO: 536385
  misc_feature: HIJSMM301A7ZEU.27.78.H01.1.454.light.4.raw

SEQ ID NO: 541320 - DNA, 497 bp, Homo sapiens; identical to SEQ ID NO: 535764
  misc_feature: HIJSMM301DIIHF.22.20.B09.1.454.light.4.raw

SEQ ID NO: 541321 - DNA, 444 bp, Homo sapiens; identical to SEQ ID NO: 535192
  misc_feature: HIJSMM301D7DQC.5.9.A09.1.454.light.4.raw

SEQ ID NO: 541322 - DNA, 480 bp, Homo sapiens
  misc_feature: HIJSMM301D88H3.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgcccctc

SEQ ID NO: 541323 - DNA, 510 bp, Homo sapiens
  misc_feature: HIJSMM301AOJRI.41.30.C08.1.454.light.4.raw
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccactgtcact

SEQ ID NO: 541324 - DNA, 509 bp, Homo sapiens
  misc_feature: HIJSMM301ER17W.2.21.B10.1.454.light.4.raw
acgctcgacacacgaccggtgctcgatttagtgtcgtcgcaagagggagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactcttcg

SEQ ID NO: 541325 - DNA, 479 bp, Homo sapiens; identical to SEQ ID NO: 535118
  misc_feature: HIJSMM301BWNQ5.13.59.F04.1.454.light.4.raw

SEQ ID NO: 541326 - DNA, 444 bp, Homo sapiens
  misc_feature: HIJSMM301AJS8Z.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 541327 - DNA, 508 bp, Homo sapiens
  misc_feature: HIJSMM301D3IG9.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 541328 - DNA, 481 bp, Homo sapiens
  misc_feature: HIJSMM301DS644.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcacca

SEQ ID NO: 541329 - DNA, 518 bp, Homo sapiens
  misc_feature: HIJSMM301AYL1X.5.58.F03.1.454.light.4.raw
  modified_base (449)..(449): a, c, t, g, unknown or other
atcagacacgcacgaccggtgctcgatttagtctgatcgagaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaacgccccctaaacttttggttatcagggcaataagcggccctcgaggggtttctaatcgcttctctggctccaagtctggcaacacggccgcctgacaatctctgggctccaggctgacgacgaggctgtattttactgctgctcatatgcaggtgatcactacttttangttcgggactgggaccaaggtccaccgtcctaggtcacgcccaacggccaaccccactgtcactcttcc

SEQ ID NO: 541330 - DNA, 484 bp, Homo sapiens; identical to SEQ ID NO: 535240
  misc_feature: HIJSMM301CDBQF.47.60.F05.1.454.light.4.raw

SEQ ID NO: 541331 - DNA, 490 bp, Homo sapiens
  misc_feature: HIJSMM301EGL8Y.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccaatctgtcttcta

SEQ ID NO: 541332 - DNA, 490 bp, Homo sapiens; identical to SEQ ID NO: 535119
  misc_feature: HIJSMM301DSMHM.51.71.G05.1.454.light.4.raw

SEQ ID NO: 541333 - DNA, 493 bp, Homo sapiens
  misc_feature: HIJSMM301D10Z8.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgcccgcgatgcgacagtcctggatggacccagtctccctccaccctgtctgcagcagtcggagacagagtcaccatcacctgccgggccagtcagaatcttggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 541334 - DNA, 484 bp, Homo sapiens
  misc_feature: HIJSMM301A3A9Z.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaaggaccaaggtggatatcagacgaa

SEQ ID NO: 541335 - DNA, 483 bp, Homo sapiens
  misc_feature: HIJSMM301B5D4A.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgcccgtggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgttggttttggctgttcggcggcgggacc

SEQ ID NO: 541336 - DNA, 497 bp, Homo sapiens
  misc_feature: HIJSMM301BYMEK.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggaccccaggtggaggatcagacgaactgtggctgcaccatctgtcttcatcttcccg

SEQ ID NO: 541337 - DNA, 483 bp, Homo sapiens; identical to SEQ ID NO: 535413
  misc_feature: HIJSMM301APEUK.26.78.H01.1.454.light.4.raw

SEQ ID NO: 541338 - DNA, 493 bp, Homo sapiens
  misc_feature: HIJSMM301BB94C.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaacgaactgtggctgcaccatctgtcttcatt

SEQ ID NO: 541339 - DNA, 496 bp, Homo sapiens; identical to SEQ ID NO: 535423
  misc_feature: HIJSMM301DA2OZ.3.33.C11.1.454.light.4.raw

SEQ ID NO: 541340 - DNA, 511 bp, Homo sapiens
  misc_feature: HIJSMM301BNMCK.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcgaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 541341 - DNA, 505 bp, Homo sapiens; identical to SEQ ID NO: 535503
  misc_feature: HIJSMM301C5SVD.8.28.C06.1.454.light.4.raw

SEQ ID NO: 541342 - DNA, 486 bp, Homo sapiens
  misc_feature: HIJSMM301APJOT.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccccaagaacttttggccaggggaccaagctggagatcaaacgaactgtggctgcaccat

SEQ ID NO: 541343 - DNA, 459 bp, Homo sapiens
  misc_feature: HIJSMM301C5V94.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 541344 - DNA, 430 bp, Homo sapiens
  misc_feature: HIJSMM301EQQ56.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttccatctgacatactcgta

SEQ ID NO: 541345 - DNA, 502 bp, Homo sapiens
  misc_feature: HIJSMM301AZB27.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgacaatctgagcggttgggtgttcggcggagggaccaaactgaccgtcctaggtcagcccaa

SEQ ID NO: 541346 - DNA, 489 bp, Homo sapiens
  misc_feature: HIJSMM301BIP86.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtt

SEQ ID NO: 541347 - DNA, 545 bp, Homo sapiens
  misc_feature: HIJSMM301BO1RH.43.59.F04.1.454.light.4.raw
tgtgagtagtcacgaccggtgctcgatttagtacacacacttagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtccctaggtcgagcccgaacggcgtcgcccccctccgggttccacctcctcgttccccgccccctccctccacctactcca

SEQ ID NO: 541348 - DNA, 486 bp, Homo sapiens; identical to SEQ ID NO: 535917
  misc_feature: HIJSMM301C6GCV.3.10.A10.1.454.light.4.raw

SEQ ID NO: 541349 - DNA, 467 bp, Homo sapiens
  misc_feature: HIJSMM301EPX1A.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcag

SEQ ID NO: 541350 - DNA, 505 bp, Homo sapiens
  misc_feature: HIJSMM301ARAQY.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 541351 - DNA, 485 bp, Homo sapiens; identical to SEQ ID NO: 539315
  misc_feature: HIJSMM301DPYM7.3.88.H11.1.454.light.4.raw

SEQ ID NO: 541352 - DNA, 460 bp, Homo sapiens; identical to SEQ ID NO: 536053
  misc_feature: HIJSMM301C0JG8.22.28.C06.1.454.light.4.raw

SEQ ID NO: 541353 - DNA, 480 bp, Homo sapiens
  misc_feature: HIJSMM301CRPR1.41.36.D03.1.454.light.4.raw
tctatactatcacgaccggtgctcgatttagctgcgtcacgatctctcttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtccg

SEQ ID NO: 541354 - DNA, 496 bp, Homo sapiens
  misc_feature: HIJSMM301CJOXS.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggcctcagggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 541355 - DNA, 498 bp, Homo sapiens
  misc_feature: HIJSMM301BZQFO.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaaccccactgt

SEQ ID NO: 541356 - DNA, 503 bp, Homo sapiens
  misc_feature: HIJSMM301C9RGL.10.27.C05.1.454.light.4.raw
catagtagtgcacgaccggtgctcgatttagacgcgatcgaagggtttggggctggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccc

SEQ ID NO: 541357 - DNA, 486 bp, Homo sapiens
  misc_feature: HIJSMM301DCRO2.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 541358 - DNA, 478 bp, Homo sapiens
  misc_feature: HIJSMM301DEQZ0.9.76.G10.1.454.light.4.raw
tgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtcctaggtcagcccaa

SEQ ID NO: 541359 - DNA, 494 bp, Homo sapiens; identical to SEQ ID NO: 534994
  misc_feature: HIJSMM301DVVZ7.27.78.H01.1.454.light.4.raw

SEQ ID NO: 541360 - DNA, 485 bp, Homo sapiens; identical to SEQ ID NO: 536040
  misc_feature: HIJSMM301C2BPF.15.1.A01.1.454.light.4.raw

SEQ ID NO: 541361 - DNA, 504 bp, Homo sapiens; identical to SEQ ID NO: 540636
  misc_feature: HIJSMM301CCU19.19.67.G01.1.454.light.4.raw

SEQ ID NO: 541362 - DNA, 509 bp, Homo sapiens
  misc_feature: HIJSMM301EU0RY.17.33.C11.1.454.light.4.raw
  modified_base (508)..(508): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttccccctnt

SEQ ID NO: 541363 - DNA, 476 bp, Homo sapiens
  misc_feature: HIJSMM301D85TF.51.76.G10.1.454.light.4.raw
cgatcgtatacacgaccggtgctcgatttagtcactcatacaggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacc

SEQ ID NO: 541364 - DNA, 493 bp, Homo sapiens
  misc_feature: HIJSMM301CE7KC.47.64.F09.1.454.light.4.raw
  modified_base (484)..(484): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatcngtcttcatt

SEQ ID NO: 541365 - DNA, 493 bp, Homo sapiens
  misc_feature: HIJSMM301CRT9D.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggaccaacttttagatgaggccgactatttctgtcacacgtgggacatgggcactgcgatcttcggcggagggaccaagctgaccgtcctgggtcagcccaaggctgccccctcggtcact

SEQ ID NO: 541366 - DNA, 515 bp, Homo sapiens
  misc_feature: HIJSMM301BYA8E.12.55.E11.1.454.light.4.raw
atacgacgtacacgaccggtgctcgatttagcactcgcacgttgggtttggggtggtagctcaggaagcagagcctggagcatctccactatggcctgggctccactacttctcaccctcctcgctcactgcacaggttcttgggccagctttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccaatcgacagctcctccaattctgcctccctcaccatctctggactcatgtctgaggacgaggctgactactactgtcagtcttatgataatacgcttgtttttttcggtcggacgggaccgaaagctgaccgtacctaggtcagcccaacggctcgccccctccggtcaa

SEQ ID NO: 541367 - DNA, 454 bp, Homo sapiens; identical to SEQ ID NO: 536347
  misc_feature: HIJSMM301DF7Q6.19.86.H09.1.454.light.4.raw

SEQ ID NO: 541368 - DNA, 484 bp, Homo sapiens; identical to SEQ ID NO: 535400
  misc_feature: HIJSMM301A6LSY.46.26.C04.1.454.light.4.raw

SEQ ID NO: 541369 - DNA, 485 bp, Homo sapiens; identical to SEQ ID NO: 535609
  misc_feature: HIJSMM301B768F.46.35.D02.1.454.light.4.raw

SEQ ID NO: 541370 - DNA, 502 bp, Homo sapiens
  misc_feature: HIJSMM301AO7XN.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtaggaaagtacaaacgaactagtggctgcacc

SEQ ID NO: 541371 - DNA, 489 bp, Homo sapiens
  misc_feature: HIJSMM301AXVCE.48.27.C05.1.454.light.4.raw
agtatacatacacgaccggtgctcgatttagacgcgatcgaagggtttgggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccgaacggtggaaggtacaaacgaactagtggctgca

SEQ ID NO: 541372 - DNA, 457 bp, Homo sapiens
  misc_feature: HIJSMM301B5T9H.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagcccaaggctgccccctcggtcactctgttcccgccctcctcatagtataga

SEQ ID NO: 541373 - DNA, 513 bp, Homo sapiens
  misc_feature: HIJSMM301CW0TS.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaacgggaccgaaggtaggaaatacaaacgaactagtggcgtgcaccactctgtcttctactcttccccg

SEQ ID NO: 541374 - DNA, 493 bp, Homo sapiens
  misc_feature: HIJSMM301D1IJR.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcagactggaccctgaagattttgcagtgtattactgtcagcagtatggtagctcaccgatcaccttcggccaagggacacgactggagattaaccgaactgtggctgcaccatctgtctt

SEQ ID NO: 541375 - DNA, 495 bp, Homo sapiens; identical to SEQ ID NO: 535007
  misc_feature: HIJSMM301ATOR8.22.5.A05.1.454.light.4.raw

SEQ ID NO: 541376 - DNA, 491 bp, Homo sapiens
  misc_feature: HIJSMM301B0XY4.47.80.H03.1.454.light.4.raw
agctcacgtacacgaccggtgctcgatttagctgtgcgtcgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagtattttgcaacttactactgtcaacagagttaccggtaccccgtacacttttggccaggggaccaaactggacatcaaacgaactgtggctgcaccatcttcg

SEQ ID NO: 541377 - DNA, 509 bp, Homo sapiens; identical to SEQ ID NO: 539269
  misc_feature: HIJSMM301CA4HK.4.57.F02.1.454.light.4.raw

SEQ ID NO: 541378 - DNA, 466 bp, Homo sapiens
  misc_feature: HIJSMM301ENIWZ.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagccccaaggccaaccccactgtcactctgttccccgccctcctccatactcgta

SEQ ID NO: 541379 - DNA, 508 bp, Homo sapiens; identical to SEQ ID NO: 536388
  misc_feature: HIJSMM301BBBHG.11.57.F02.1.454.light.4.raw

SEQ ID NO: 541380 - DNA, 495 bp, Homo sapiens
  misc_feature: HIJSMM301A1ZXM.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtgcgtcg

SEQ ID NO: 541381 - DNA, 447 bp, Homo sapiens; identical to SEQ ID NO: 535201
  misc_feature: HIJSMM301CU5IC.18.9.A09.1.454.light.4.raw

SEQ ID NO: 541382 - DNA, 499 bp, Homo sapiens
  misc_feature: HIJSMM301BVTW0.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttcccg

SEQ ID NO: 541383 - DNA, 484 bp, Homo sapiens; identical to SEQ ID NO: 535400
  misc_feature: HIJSMM301A582C.46.26.C04.1.454.light.4.raw

SEQ ID NO: 541384 - DNA, 502 bp, Homo sapiens
  misc_feature: HIJSMM301B2MOV.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaacgaactgtggctgcaccatctgtcttcatcttcccg

SEQ ID NO: 541385 - DNA, 494 bp, Homo sapiens; identical to SEQ ID NO: 534994
  misc_feature: HIJSMM301CL74T.27.78.H01.1.454.light.4.raw

SEQ ID NO: 541386 - DNA, 486 bp, Homo sapiens; identical to SEQ ID NO: 537617
  misc_feature: HIJSMM301A8OEN.10.53.E09.1.454.light.4.raw

SEQ ID NO: 541387 - DNA, 513 bp, Homo sapiens
  misc_feature: HIJSMM301CQTBZ.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 541388 - DNA, 486 bp, Homo sapiens
  misc_feature: HIJSMM301DT34D.7.76.G10.1.454.light.4.raw
  modified_base (456)..(456): a, c, t, g, unknown or other
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggacgaacggtaggnggatcaacgaaactagtggcgtgcaccact

SEQ ID NO: 541389 - DNA, 488 bp, Homo sapiens; identical to SEQ ID NO: 539884
  misc_feature: HIJSMM301CX6FQ.7.85.H08.1.454.light.4.raw

SEQ ID NO: 541390 - DNA, 496 bp, Homo sapiens; identical to SEQ ID NO: 536690
  misc_feature: HIJSMM301D1M3D.40.23.C01.1.454.light.4.raw

SEQ ID NO: 541391 - DNA, 462 bp, Homo sapiens
  misc_feature: HIJSMM301ERSRL.52.9.A09.1.454.light.4.raw
cgcagtacgacacgaccggtgctcgatttagcgagacgcgcagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcggagggaccaaggtggagatcaaacgaa

SEQ ID NO: 541392 - DNA, 497 bp, Homo sapiens; identical to SEQ ID NO: 535664
  misc_feature: HIJSMM301ALF13.22.14.B03.1.454.light.4.raw

SEQ ID NO: 541393 - DNA, 499 bp, Homo sapiens
  misc_feature: HIJSMM301CTAL1.48.1.A01.1.454.light.4.raw
agtatacatacacgaccggtgctcgatttagacgtctcatcaaggggcaggagtcagacccagtcaggactcagcatggacatgagggtccccgctcagctcctggggctcctgctgctctggttcccaggttccagatgcgacatccagataacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttccccg

SEQ ID NO: 541394 - DNA, 494 bp, Homo sapiens
  misc_feature: HIJSMM301ETQKD.40.37.D04.1.454.light.4.raw
tctagcgactcacgaccggtgctcgatttagtagcatactgttgggtttggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccgtcggtaccgacgagtggagtgtctaacgaaacg

SEQ ID NO: 541395 - DNA, 492 bp, Homo sapiens
  misc_feature: HIJSMM301DCDWB.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggagggaccaacgtggaggtcaaacgaactgtggctgcaccatctgt

SEQ ID NO: 541396 - DNA, 508 bp, Homo sapiens
  misc_feature: HIJSMM301D2IHY.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccc

SEQ ID NO: 541397 - DNA, 491 bp, Homo sapiens; identical to SEQ ID NO: 538388
  misc_feature: HIJSMM301EGZYE.51.81.H04.1.454.light.4.raw

SEQ ID NO: 541398 - DNA, 444 bp, Homo sapiens; identical to SEQ ID NO: 540477
  misc_feature: HIJSMM301ERH3T.17.21.B10.1.454.light.4.raw

SEQ ID NO: 541399 - DNA, 406 bp, Homo sapiens
  misc_feature: HIJSMM301DYMXH.49.68.G02.1.454.light.4.raw
agtcgagagacacgaccggtgctcgatttagtcgatagtgaagggaaagggggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttcccgccctcctctctctcgact

SEQ ID NO: 541400 - DNA, 494 bp, Homo sapiens
  misc_feature: HIJSMM301DD5R9.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcta

SEQ ID NO: 541401 - DNA, 494 bp, Homo sapiens; identical to SEQ ID NO: 534992
  misc_feature: HIJSMM301BOCUT.9.1.A01.1.454.light.4.raw

SEQ ID NO: 541402 - DNA, 512 bp, Homo sapiens
  misc_feature: HIJSMM301BTKS2.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccctcctca

SEQ ID NO: 541403 - DNA, 481 bp, Homo sapiens; identical to SEQ ID NO: 541328
  misc_feature: HIJSMM301BU4L0.3.38.D05.1.454.light.4.raw

SEQ ID NO: 541404 - DNA, 478 bp, Homo sapiens
  misc_feature: HIJSMM301DWRUW.4.10.A10.1.454.light.4.raw
agcactgtagcacgaccggtgctcgatttagcgtcgatctcaggggagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactgtggctgcaccatctgctt

SEQ ID NO: 541405 - DNA, 444 bp, Homo sapiens; identical to SEQ ID NO: 535192
  misc_feature: HIJSMM301BDWBL.5.9.A09.1.454.light.4.raw

SEQ ID NO: 541406 - DNA, 472 bp, Homo sapiens; identical to SEQ ID NO: 535992
  misc_feature: HIJSMM301A5EDA.11.76.G10.1.454.light.4.raw

SEQ ID NO: 541407 - DNA, 490 bp, Homo sapiens
  misc_feature: HIJSMM301CWY1B.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccgaaggcggagatcagacgaactgtggctgcaccatctgtcttcta

SEQ ID NO: 541408 - DNA, 491 bp, Homo sapiens
  misc_feature: HIJSMM301EOJ5H.41.38.D05.1.454.light.4.raw
tctatactatcacgaccggtgctcgatttagtatctgatagttgggtttggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaggttgagaccaacgaactgtggctgcaccatctgtcttcat

SEQ ID NO: 541409 - DNA, 492 bp, Homo sapiens
  misc_feature: HIJSMM301BSDSS.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 541410 - DNA, 516 bp, Homo sapiens
  misc_feature: HIJSMM301D3QP7.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 541411 - DNA, 483 bp, Homo sapiens
  misc_feature: HIJSMM301AGX3X.22.29.C07.1.454.light.4.raw
  modified_base (453)..(453): a, c, t, g, unknown or other
  modified_base (460)..(460): a, c, t, g, unknown or other
  modified_base (481)..(481): a, c, t, g, unknown or other
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcacccatcagcagcctgcagtctgaagatttttgcagtttattactgtcagcagtataattactggcctcggacgtcgtcacggacgaagnggagtanaacgaacagtgcgtgcacacnct

SEQ ID NO: 541412 - DNA, 491 bp, Homo sapiens
  misc_feature: HIJSMM301EYFED.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttctccatgcaaggtacacactggccttttggccaggggaccaacctggagatcaaatgaactgtggctgcacatctgtctt

SEQ ID NO: 541413 - DNA, 491 bp, Homo sapiens
  misc_feature: HIJSMM301AJF27.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcta

SEQ ID NO: 541414 - DNA, 443 bp, Homo sapiens
  misc_feature: HIJSMM301ATFY7.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaaactggatgtggtattcggcggagggacccacgtaaccgtcctaggtcagcccaaggctgccccctcggtcactctgttcccaccctcctcgtatctcctcg

SEQ ID NO: 541415 - DNA, 494 bp, Homo sapiens
  misc_feature: HIJSMM301A3XBM.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtctttat

SEQ ID NO: 541416 - DNA, 497 bp, Homo sapiens
  misc_feature: HIJSMM301A0ZUM.22.65.F10.1.454.light.4.raw
  modified_base (486)..(486): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccgactacacctccgtccgaacggacgacgacgtagaggaagtaaactaaacgtacgtggtcgtcncgaccactctc

SEQ ID NO: 541417 - DNA, 509 bp, Homo sapiens
  misc_feature: HIJSMM301B1PRP.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 541418 - DNA, 514 bp, Homo sapiens
  misc_feature: HIJSMM301AQKXX.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 541419 - DNA, 513 bp, Homo sapiens
  misc_feature: HIJSMM301BOYFJ.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaatacaaacgaacctagtggctgcaccatctgtcttcta

SEQ ID NO: 541420 - DNA, 494 bp, Homo sapiens; identical to SEQ ID NO: 534992
  misc_feature: HIJSMM301DVCWM.9.1.A01.1.454.light.4.raw

SEQ ID NO: 541421 - DNA, 491 bp, Homo sapiens; identical to SEQ ID NO: 535176
  misc_feature: HIJSMM301AQF3R.13.39.D06.1.454.light.4.raw

SEQ ID NO: 541422 - DNA, 483 bp, Homo sapiens; identical to SEQ ID NO: 535480
  misc_feature: HIJSMM301DBSDE.46.26.C04.1.454.light.4.raw

SEQ ID NO: 541423 - DNA, 500 bp, Homo sapiens
  misc_feature: HIJSMM301A9YK1.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactgtggctgcaccatctgtcttcat

SEQ ID NO: 541424 - DNA, 481 bp, Homo sapiens
  misc_feature: HIJSMM301D5DPY.48.35.D02.1.454.light.4.raw
agtatacatacacgaccggtgctcgatttagcacacgatagttgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtgg

SEQ ID NO: 541425 - DNA, 488 bp, Homo sapiens
  misc_feature: HIJSMM301CM3LT.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggacgaaggtaggagatcaaacgaaatgtggcgtgcaccat

SEQ ID NO: 541426 - DNA, 512 bp, Homo sapiens
  misc_feature: HIJSMM301AVY4O.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacaacaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctgtt

SEQ ID NO: 541427 - DNA, 488 bp, Homo sapiens
  misc_feature: HIJSMM301EQYBL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcgcggagggaccaaggcggagatcagacgaactgtggctgcaccatctgtcttcta

SEQ ID NO: 541428 - DNA, 493 bp, Homo sapiens; identical to SEQ ID NO: 538753
  misc_feature: HIJSMM301AFH6J.27.78.H01.1.454.light.4.raw

SEQ ID NO: 541429 - DNA, 519 bp, Homo sapiens
  misc_feature: HIJSMM301DHIZI.17.33.C11.1.454.light.4.raw
cgtagactagcacgaccggtgctcgatttagagtgagctcgttgggtttgggggcgccaggggtcccttccaatatcaacaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcctcctacg

SEQ ID NO: 541430 - DNA, 492 bp, Homo sapiens
  misc_feature: HIJSMM301C1KW7.10.65.F10.1.454.light.4.raw
  modified_base (432)..(432): a, c, t, g, unknown or other
  modified_base (463)..(463): a, c, t, g, unknown or other
  modified_base (474)..(474): a, c, t, g, unknown or other
catagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgatttgcgacttactactgtcaacagagttccggaacccgttacttcgtcggnggacgacgtaggagagataacgaacagtggngtcgcacactntgtctctatctccgtcca

SEQ ID NO: 541431 - DNA, 474 bp, Homo sapiens
  misc_feature: HIJSMM301DITCE.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggaccaaggtggagatcaaacgaactgt

SEQ ID NO: 541432 - DNA, 525 bp, Homo sapiens
  misc_feature: HIJSMM301CKJQK.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcgaaagctgccctgacactgtctggtgtgcagcctgaggacgaggctgactattactgcctactctactttgtggtgctgtgctattcggcggagggaccgaagactgaccgtccttaagtacagcccaacggactgccccctcccggtcgactcctgttcccgtaccctccct

SEQ ID NO: 541433 - DNA, 494 bp, Homo sapiens
  misc_feature: HIJSMM301BMVH3.26.55.E11.1.454.light.4.raw
agactatactcacgaccggtgctcgatttagcactcgcacgttgggtttgggggcaggagtccaggtctcagtcagggacacgagacgatggaacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctataccttttggccaggggaccaagctggagatcacaggaactgtggctgcacc

SEQ ID NO: 541434 - DNA, 502 bp, Homo sapiens
  misc_feature: HIJSMM301A71HE.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcagagggtcatcctctcttgttctggaggcagctccaacatcggaggacatcctgtgagctggtaccaacacctcccaggaacggcccccaaactctcatctatacagattctaagaggcccgcaggggtcccagatcgattctctggctccaggtctggcacctcagcctcccctgtccatcagtggactccggtctgaggatgaggctgactactattgttcaggatgggattacagcctacatgctcggctgttcggcggagggaccaaactgaccgtcttaggtcagcccaaggctcgccccccg

SEQ ID NO: 541435 - DNA, 475 bp, Homo sapiens
  misc_feature: HIJSMM301AECF8.49.9.A09.1.454.light.4.raw
agtcgagagacacgaccggtgctcgatttagcgagacgcgcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacagattttactttcaccatcagcaggctgcagcctgaagatattgcaacatattactgtcaacagtatgatagtctcccgctcactttcggtcgggggaccggaacggtggagagtacaagacgaactagtgg

SEQ ID NO: 541436 - DNA, 488 bp, Homo sapiens; identical to SEQ ID NO: 537260
  misc_feature: HIJSMM301AKBOB.47.70.G04.1.454.light.4.raw

SEQ ID NO: 541437 - DNA, 484 bp, Homo sapiens; identical to SEQ ID NO: 538157
  misc_feature: HIJSMM301BFZZD.26.70.G04.1.454.light.4.raw

SEQ ID NO: 541438 - DNA, 486 bp, Homo sapiens; identical to SEQ ID NO: 539294
  misc_feature: HIJSMM301DQJIH.12.33.C11.1.454.light.4.raw

SEQ ID NO: 541439 - DNA, 495 bp, Homo sapiens
  misc_feature: HIJSMM301C6DFY.48.35.D02.1.454.light.4.raw
agtatacatacacgaccggtgctcgatttagcacacgatagttgggtttgggggtgggctcaggaggcagagctctgggaatctcaccatggcctggacccctctcctgctccccctcctcacttctgcacagtctctgaggcctcctatgagctgacacagccaccctcggtgtcagtgtccccaggacaaacggccaggatcacctgctctggagatgcattgccaaaaaataatgcttattggtaccagcagaagtcaggccaggccctgtgctggtcatctttgaggacaacaaacgaccctccgggatccctgagagattctctggctccagctcagggacaatggccaccttgactatcaatggggccaggtggacgatgaggctgactactactgttcctcaacagacagtagtggtgatcgagggctgttcggcggagggccaagctgaccgtcctaagtcagcccaaggctgccccctcggtcact

SEQ ID NO: 541440 - DNA, 502 bp, Homo sapiens
  misc_feature: HIJSMM301AJD1G.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcaggtgggtctgggacagacttcactctcaccatcagcagcctagagcctgaagtattttgctagtttattactgtcagcagcgtagcaactcggcctctctactttcggcggacgggaccgaggtaggagatacaaacgactgtggctgcaccatctgtctt

SEQ ID NO: 541441 - DNA, 488 bp, Homo sapiens
  misc_feature: HIJSMM301BGH55.51.61.F06.1.454.light.4.raw
cgatcgtatacacgaccggtgctcgatttagctacgctctaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggtccaaggaccgaaggtaggaaagtacaaacgaactagtggctgcaccatctgtt

SEQ ID NO: 541442 - DNA, 500 bp, Homo sapiens
  misc_feature: HIJSMM301D0DG6.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttcccg

SEQ ID NO: 541443 - DNA, 453 bp, Homo sapiens
  misc_feature: HIJSMM301CACTM.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacggagta

SEQ ID NO: 541444 - DNA, 487 bp, Homo sapiens
  misc_feature: HIJSMM301BQEWR.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtatcagacgaa

SEQ ID NO: 541445 - DNA, 502 bp, Homo sapiens
  misc_feature: HIJSMM301AODNX.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtggaatacaaacgaactacgtggctgcaccatctgtcttctatcttccccg

SEQ ID NO: 541446 - DNA, 499 bp, Homo sapiens
  misc_feature: HIJSMM301CTZD3.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccc

SEQ ID NO: 541447 - DNA, 496 bp, Homo sapiens
  misc_feature: HIJSMM301EJ04Y.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaacgggaccgaaggtaggaagtcaaacgaaactagtggctgcaccatctgtctt

SEQ ID NO: 541448 - DNA, 481 bp, Homo sapiens
  misc_feature: HIJSMM301DLRXU.3.38.D05.1.454.light.4.raw
agacgcactccacgaccggtgctcgatttagtatctgatagttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcacca

SEQ ID NO: 541449 - DNA, 512 bp, Homo sapiens
  misc_feature: HIJSMM301EFMQK.17.31.C09.1.454.light.4.raw
cgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgcctgaccctttcgggtgcgcagcctgaggatgaggctgagtattactgcttgctctcctatagtggtgttcgggtgttcggcggagggaccaagctgaccgtcctaggtcagcccg

SEQ ID NO: 541450 - DNA, 487 bp, Homo sapiens; identical to SEQ ID NO: 540408
  misc_feature: HIJSMM301DM651.41.33.C11.1.454.light.4.raw

SEQ ID NO: 541451 - DNA, 492 bp, Homo sapiens
  misc_feature: HIJSMM301B5Y4L.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttctactttgtcgacgggacgaaactaggatatacagagaactagtggctgca

SEQ ID NO: 541452 - DNA, 477 bp, Homo sapiens
  misc_feature: HIJSMM301BVDFB.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgg

SEQ ID NO: 541453 - DNA, 491 bp, Homo sapiens; identical to SEQ ID NO: 535176
  misc_feature: HIJSMM301DW0V1.13.39.D06.1.454.light.4.raw

SEQ ID NO: 541454 - DNA, 503 bp, Homo sapiens
  misc_feature: HIJSMM301BGV91.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaactagtggctgcaccatctgtcttcatcttccccg

SEQ ID NO: 541455 - DNA, 515 bp, Homo sapiens
  misc_feature: HIJSMM301A0YIZ.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcc

SEQ ID NO: 541456 - DNA, 484 bp, Homo sapiens
  misc_feature: HIJSMM301C1YY1.48.75.G09.1.454.light.4.raw
  modified_base (469)..(469): a, c, t, g, unknown or other
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttaattactgcatgcaaggtaatcttccttcccatacactttgtccgggaccgaacggaggatntcaaagaaactagtg

SEQ ID NO: 541457 - DNA, 444 bp, Homo sapiens
  misc_feature: HIJSMM301CT884.7.18.B07.1.454.light.4.raw
cgtgtctctacacgaccggtgctcgatttagtcgctgcgtaagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctctagagacacg

SEQ ID NO: 541458 - DNA, 485 bp, Homo sapiens
  misc_feature: HIJSMM301AKU63.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagttgaagtccaggcagaagatgaggctgactattattgtcaatcaacagacagtagtgggaaatatgtggtattcggcggagggaccaaactgaccgtcctaggtcagcccaaggctgcccccc

SEQ ID NO: 541459 - DNA, 485 bp, Homo sapiens; identical to SEQ ID NO: 535688
  misc_feature: HIJSMM301DCH83.19.5.A05.1.454.light.4.raw

SEQ ID NO: 541460 - DNA, 477 bp, Homo sapiens
  misc_feature: HIJSMM301DFGGE.9.76.G10.1.454.light.4.raw
tgatacgtctcacgaccggtgctcgatttagtcactcatacaggggggtagagaagacaggactcaggacaatctccagcatggcctggtcccctctcttcctcaccctcatcactcactgtgcagggtcctgggcccagtctgtgctgactcagccaccctcggtgtctggagccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtcctaggtcagcccaa

SEQ ID NO: 541461 - DNA, 507 bp, Homo sapiens
  misc_feature: HIJSMM301CC1GH.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgcc

SEQ ID NO: 541462 - DNA, 497 bp, Homo sapiens
  misc_feature: HIJSMM301BP8S7.51.87.H10.1.454.light.4.raw
cgatcgtatacacgaccggtgctcgatttagcagtactgcgttgggtttgggggagtcagtctcagtcgggacacagcatggacatgagggtccccgctcagctcctggggctcctgctactctggctccgaggtgccagatgtgacatccagatgacccagtctccatcctccctgtctgcatctataggagacagagtcacaatcccttgccggtcaagtcaaaacattagcaactatttaaattggtatcaacagaaaccagggaaagcccctaacctcctgatctatgctgcttccactttgcaaagtggggtcccatcgaggttcagtggcagtggatctgggacagatttcagtctcaccatcaccaatctgcgacctgaagattttgcaacttattattgtcaacaggcttacatccacccctctctactttcggcggagggaccaaggtggagatacaacgaactgtggctgcaccatctgtcttcatt

SEQ ID NO: 541463 - DNA, 505 bp, Homo sapiens
  misc_feature: HIJSMM301BQ8MO.4.39.D06.1.454.light.4.raw
agcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcgggggtccctgatcgcttctctgcctccaaggctggcaacacggcctccctgaccgtctctgggctccaggctgaggatgaggctgattattattgcagctcatatgcaggcagttacaatgtgatattcggcggagggaccaaaactgaccgtcctaggtcagcccaaggctgccccctcggt

SEQ ID NO: 541464 - DNA, 473 bp, Homo sapiens; identical to SEQ ID NO: 536937
  misc_feature: HIJSMM301B44WX.13.76.G10.1.454.light.4.raw

SEQ ID NO: 541465 - DNA, 486 bp, Homo sapiens
  misc_feature: HIJSMM301AE5AW.5.7.A07.1.454.light.4.raw
atcagacacgcacgaccggtgctcgatttagcacgtgtcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgccgggcaagtcagaacattaccacctatttacattggtatctgccagaagccagggagagcccctaagctcctgatctatgcttcatccaatttgcacagtggggtcccgtcaaggttcagtggcggtggctctgagacagatttcactctcaccatcagcagtctgcaacctgaagattttgcaacttactactgtcaacagagttacggtaccccctctactcgtcggaggacgacgtaaagtgagtactaacgaactacgtgtcgtcgtcacca

SEQ ID NO: 541466 - DNA, 447 bp, Homo sapiens; identical to SEQ ID NO: 535201
  misc_feature: HIJSMM301ATWLZ.18.9.A09.1.454.light.4.raw

SEQ ID NO: 541467 - DNA, 498 bp, Homo sapiens
  misc_feature: HIJSMM301BK36Z.48.83.H06.1.454.light.4.raw
  modified_base (229)..(229): a, c, t, g, unknown or other
agtatacatacacgaccggtgctcgattagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggganaaatatgtttgttggtatcaacagaagccaggccagtcccctgtattggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccg

SEQ ID NO: 541468 - DNA, 512 bp, Homo sapiens
  misc_feature: HIJSMM301COMJE.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 541469 - DNA, 493 bp, Homo sapiens
  misc_feature: HIJSMM301B59SG.5.57.F02.1.454.light.4.raw
atcagacacgcacgaccggtgctcgatttagctcgatatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 541470 - DNA, 478 bp, Homo sapiens; identical to SEQ ID NO: 535129
  misc_feature: HIJSMM301AS73B.11.11.A11.1.454.light.4.raw

SEQ ID NO: 541471 - DNA, 476 bp, Homo sapiens
  misc_feature: HIJSMM301BY2J1.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtggctgcacca

SEQ ID NO: 541472 - DNA, 473 bp, Homo sapiens
  misc_feature: HIJSMM301CKQHJ.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 541473 - DNA, 504 bp, Homo sapiens; identical to SEQ ID NO: 535128
  misc_feature: HIJSMM301AKMBU.19.85.H08.1.454.light.4.raw

SEQ ID NO: 541474 - DNA, 492 bp, Homo sapiens
  misc_feature: HIJSMM301A17TN.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggaccgaaggtggagatcaacgaactgtggctgcaccatctgtt

SEQ ID NO: 541475 - DNA, 474 bp, Homo sapiens
  misc_feature: HIJSMM301ECNMT.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtggctgca

SEQ ID NO: 541476 - DNA, 512 bp, Homo sapiens
  misc_feature: HIJSMM301BWVD1.41.58.F03.1.454.light.4.raw
tctatactatcacgaccggtgctcgatttagtctgatcgagaagggaaagggggcttcagctgtgggtagagaagacaggactcaggacaatctccagcatggccagcttccctctcctcctcaccctcctcactcactgtgcagggtcctgggcccagtctgtgctgactcagtcaccctctgcgtctgggacccccgggcagagggtcaccatgtattgtgctgggagcaggtccaacatcggacgtaatactgtgagttggtatcagcaagtcccaggaacggcccccaaactcctcgtttctggaaacaatcagcggccctcaggagtccctgagcgattctctggctccaagtctggcacctcagcctccctggccatcagagggctccagtccgaggatgagggtgtttattattgtgcagtctgggatgacagtctgaatggtcattgggtgttcggcggagggaccaaggttgaccgtcctaggtcagccccaggctgcccccc

SEQ ID NO: 541477 - DNA, 473 bp, Homo sapiens
  misc_feature: HIJSMM301AXSJP.18.76.G10.1.454.light.4.raw
  modified_base (419)..(419): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtccaccaaggttcagcggaagtggatctgggacagattttaatttcaccatcagcagcctccaacgtgatgatgttgcaacatactattgtcagcaatatgatttntctcctccgagtgcctactttgggtcggggaccgaaggtggacatacaaacgaa

SEQ ID NO: 541478 - DNA, 480 bp, Homo sapiens
  misc_feature: HIJSMM301ALNM0.52.1.A01.1.454.light.4.raw
cgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcaccatctgtt

SEQ ID NO: 541479 - DNA, 469 bp, Homo sapiens; identical to SEQ ID NO: 536091
  misc_feature: HIJSMM301C8NAN.3.82.H05.1.454.light.4.raw

SEQ ID NO: 541480 - DNA, 464 bp, Homo sapiens; identical to SEQ ID NO: 537111
  misc_feature: HIJSMM301DAKBH.17.28.C06.1.454.light.4.raw

SEQ ID NO: 541481 - DNA, 505 bp, Homo sapiens; identical to SEQ ID NO: 535503
  misc_feature: HIJSMM301A6VKN.8.28.C06.1.454.light.4.raw

SEQ ID NO: 541482 - DNA, 482 bp, Homo sapiens
  misc_feature: HIJSMM301C1Y4H.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaactttggcagggaccaagctggagatcaaacgaactgtggctgcaccat

SEQ ID NO: 541483 - DNA, 419 bp, Homo sapiens
  misc_feature: HIJSMM301BY37T.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 541484 - DNA, 523 bp, Homo sapiens
  misc_feature: HIJSMM301ATKE4.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggacggacggaacgaagggacggagtactacgaacggaacgtaacgttggtcggtcgtcgacccaacctacttcgttcgttccttta

SEQ ID NO: 541485 - DNA, 516 bp, Homo sapiens
  misc_feature: HIJSMM301D8VB3.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtcctaggtcagcccaaggctgcccctcggtcactc

SEQ ID NO: 541486 - DNA, 499 bp, Homo sapiens; identical to SEQ ID NO: 535319
  misc_feature: HIJSMM301BJH3B.17.27.C05.1.454.light.4.raw

SEQ ID NO: 541487 - DNA, 442 bp, Homo sapiens
  misc_feature: HIJSMM301BTMCR.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatcctctcg

SEQ ID NO: 541488 - DNA, 511 bp, Homo sapiens
  misc_feature: HIJSMM301A35T4.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttcccaccctcct

SEQ ID NO: 541489 - DNA, 493 bp, Homo sapiens
  misc_feature: HIJSMM301DM09S.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcaccatctgtt

SEQ ID NO: 541490 - DNA, 528 bp, Homo sapiens
  misc_feature: HIJSMM301ELA6F.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgacgggaaccgaacggtaggaaggtacgaaacgaaacgtacgtaggcgtgcaccactctcgtcgttctactcttcccgtccctact

SEQ ID NO: 541491 - DNA, 521 bp, Homo sapiens
  misc_feature: HIJSMM301B4HY5.27.23.C01.1.454.light.4.raw
agcgtcgtctcacgaccggtgctcgatttagtacacgtgattagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctcgccccctcggtcactctgttcccgccct

SEQ ID NO: 541492 - DNA, 460 bp, Homo sapiens; identical to SEQ ID NO: 536053
  misc_feature: HIJSMM301A3JWB.22.28.C06.1.454.light.4.raw

SEQ ID NO: 541493 - DNA, 518 bp, Homo sapiens
  misc_feature: HIJSMM301EQWXE.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaaccggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccgttgggtgttcggcgggaggaccaagctgaccgtcctaagtcagcccaaggctcgccccctcggtcactctcgttcccaccctctcg

SEQ ID NO: 541494 - DNA, 481 bp, Homo sapiens
  misc_feature: HIJSMM301CQJ27.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcacca

SEQ ID NO: 541495 - DNA, 494 bp, Homo sapiens; identical to SEQ ID NO: 534994
  misc_feature: HIJSMM301CCT0F.27.78.H01.1.454.light.4.raw

SEQ ID NO: 541496 - DNA, 479 bp, Homo sapiens
  misc_feature: HIJSMM301A7GOL.7.76.G10.1.454.light.4.raw
cgtgtctctacacgaccggtgctcgatttagtcactcatacagggggcgaggagtcagacccagtcaggacacagcatggacatgagggtccccgcctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcggggacggaacgtaggagatacaacgaacctagtggcgt

SEQ ID NO: 541497 - DNA, 493 bp, Homo sapiens; identical to SEQ ID NO: 535084
  misc_feature: HIJSMM301BIZTN.47.64.F09.1.454.light.4.raw

SEQ ID NO: 541498 - DNA, 494 bp, Homo sapiens
  misc_feature: HIJSMM301BC6YU.41.67.G01.1.454.light.4.raw
tctatactatcacgaccggtgctcgatttagagtatacatattgggtttgggggagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgggacaggggcgttttggtgttcggcggagggaccaggactgaccgtcctgggtcagcccaaggctgccccctcggt

SEQ ID NO: 541499 - DNA, 512 bp, Homo sapiens
  misc_feature: HIJSMM301AVKQU.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtcccgtggacgttcgccaaggaccaggtggcatcaacgaactgtggctgcaccatctgtcttcatcttccccg

SEQ ID NO: 541500 - DNA, 441 bp, Homo sapiens; identical to SEQ ID NO: 534971
  misc_feature: HIJSMM301CV5H3.11.3.A03.1.454.light.4.raw

SEQ ID NO: 541501 - DNA, 502 bp, Homo sapiens
  misc_feature: HIJSMM301EDQHP.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 541502 - DNA, 514 bp, Homo sapiens
  misc_feature: HIJSMM301DADFF.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctcg

SEQ ID NO: 541503 - DNA, 497 bp, Homo sapiens
  misc_feature: HIJSMM301AU1LW.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcagtttattactgtcagcagcgtagcaactggcctttcactttcggcccggggaccaaagtggaaatcaaacgaactgtggctgcaccatctgtcttcatcttcccgccat

SEQ ID NO: 541504 - DNA, 504 bp, Homo sapiens; identical to SEQ ID NO: 535561
  misc_feature: HIJSMM301CQF9S.4.57.F02.1.454.light.4.raw

SEQ ID NO: 541505 - DNA, 507 bp, Homo sapiens
  misc_feature: HIJSMM301CWFQQ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctcgggaccaaggtggagatcaacgaactgtggctgcaccatctgtcttcta

SEQ ID NO: 541506 - DNA, 499 bp, Homo sapiens
  misc_feature: HIJSMM301BA9DS.51.38.D05.1.454.light.4.raw
cgatcgtatacacgaccggtgctcgatttagtatctgatagttgggtttgggggctttgcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttcccaccctcctctcgtagcact

SEQ ID NO: 541507 - DNA, 354 bp, Homo sapiens; identical to SEQ ID NO: 535026
  misc_feature: HIJSMM301BQ24I.19.22.B11.1.454.light.4.raw

SEQ ID NO: 541508 - DNA, 495 bp, Homo sapiens
  misc_feature: HIJSMM301A53IQ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagttactactttacctcaagtgatcaccttcggccaagggacacgactggagattaaacgaactgtggctgcaccatctgtctt

SEQ ID NO: 541509 - DNA, 517 bp, Homo sapiens; identical to SEQ ID NO: 538982
  misc_feature: HIJSMM301EDT73.49.9.A09.1.454.light.4.raw

SEQ ID NO: 541510 - DNA, 418 bp, Homo sapiens
  misc_feature: HIJSMM301B2A9V.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccatactcgta

SEQ ID NO: 541511 - DNA, 501 bp, Homo sapiens
  misc_feature: HIJSMM301CY1WP.7.31.C09.1.454.light.4.raw
cgtgtctctacacgaccggtgctcgatttagacgtctcatcaaggaaggaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcagccaaggctgccccctc

SEQ ID NO: 541512 - DNA, 492 bp, Homo sapiens
  misc_feature: HIJSMM301B3YZ0.47.78.H01.1.454.light.4.raw
agctcacgtacacgaccggtgctcgatttagtgtgagtagtttgggtttgggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaacctggagatcaaatgaactgtggctgcaccatctgtctt

SEQ ID NO: 541513 - DNA, 496 bp, Homo sapiens; identical to SEQ ID NO: 535541
  misc_feature: HIJSMM301E2WQP.3.33.C11.1.454.light.4.raw

SEQ ID NO: 541514 - DNA, 495 bp, Homo sapiens
  misc_feature: HIJSMM301AO72E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactagtggcgtcgcaccactctcgtcttcta

SEQ ID NO: 541515 - DNA, 478 bp, Homo sapiens
  misc_feature: HIJSMM301CSD6W.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgacgtcctaagtcagccccg

SEQ ID NO: 541516 - DNA, 494 bp, Homo sapiens; identical to SEQ ID NO: 539894
  misc_feature: HIJSMM301AO3XY.16.53.E09.1.454.light.4.raw

SEQ ID NO: 541517 - DNA, 474 bp, Homo sapiens
  misc_feature: HIJSMM301EP2Z9.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgccgctatgtcttcggaactgggaccaaggtcaccgtcctaagtcagcccaac

SEQ ID NO: 541518 - DNA, 441 bp, Homo sapiens; identical to SEQ ID NO: 535074
  misc_feature: HIJSMM301EUA45.11.3.A03.1.454.light.4.raw

SEQ ID NO: 541519 - DNA, 489 bp, Homo sapiens
  misc_feature: HIJSMM301CAPHB.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtctaagcgaactgtggcgtgcaccat

SEQ ID NO: 541520 - DNA, 361 bp, Homo sapiens; identical to SEQ ID NO: 540413
  misc_feature: HIJSMM301AHOBN.3.57.F02.1.454.light.4.raw

SEQ ID NO: 541521 - DNA, 509 bp, Homo sapiens
  misc_feature: HIJSMM301ENW5C.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactctcgtt

SEQ ID NO: 541522 - DNA, 454 bp, Homo sapiens; identical to SEQ ID NO: 534964
  misc_feature: HIJSMM301CFGYF.19.86.H09.1.454.light.4.raw

SEQ ID NO: 541523 - DNA, 444 bp, Homo sapiens; identical to SEQ ID NO: 534993
  misc_feature: HIJSMM301D5T7Y.5.9.A09.1.454.light.4.raw

SEQ ID NO: 541524 - DNA, 493 bp, Homo sapiens
  misc_feature: HIJSMM301CK057.40.11.A11.1.454.light.4.raw
tctagcgactcacgaccggtgctcgatttagctacgactgcaggggcagcaagatggtgttgcagacccaggtcttcatttttctgttgctctggatctctggtgccctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatcttcccgccat

SEQ ID NO: 541525 - DNA, 509 bp, Homo sapiens
  misc_feature: HIJSMM301A2ZNK.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgccccctcggtcactcg

SEQ ID NO: 541526 - DNA, 503 bp, Homo sapiens; identical to SEQ ID NO: 535140
  misc_feature: HIJSMM301CJDFO.18.37.D04.1.454.light.4.raw

SEQ ID NO: 541527 - DNA, 447 bp, Homo sapiens; identical to SEQ ID NO: 535882
  misc_feature: HIJSMM301D4X53.18.9.A09.1.454.light.4.raw
  modified_base (429)..(429): a, c, t, g, unknown or other

SEQ ID NO: 541528 - DNA, 485 bp, Homo sapiens; identical to SEQ ID NO: 535652
  misc_feature: HIJSMM301BZ66E.19.71.G05.1.454.light.4.raw

SEQ ID NO: 541529 - DNA, 505 bp, Homo sapiens; identical to SEQ ID NO: 535987
  misc_feature: HIJSMM301EL229.18.37.D04.1.454.light.4.raw

SEQ ID NO: 541530 - DNA, 485 bp, Homo sapiens
  misc_feature: HIJSMM301BNC2F.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagttttggccaggggaccaagctggagatcaaacgaactgtgg

SEQ ID NO: 541531 - DNA, 404 bp, Homo sapiens; identical to SEQ ID NO: 535530
  misc_feature: HIJSMM301ATZHL.4.35.D02.1.454.light.4.raw

SEQ ID NO: 541532 - DNA, 510 bp, Homo sapiens
  misc_feature: HIJSMM301ALKTY.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggagagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcat

SEQ ID NO: 541533 - DNA, 499 bp, Homo sapiens
  misc_feature: HIJSMM301BIJDL.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaatcaaaacgaactgtggctgcacca

SEQ ID NO: 541534 - DNA, 468 bp, Homo sapiens
  misc_feature: HIJSMM301CP07V.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctggactgaagtgcatatgaagagaactgtgg

SEQ ID NO: 541535 - DNA, 497 bp, Homo sapiens
  misc_feature: HIJSMM301AKZLL.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaaactgtggctgcacc

SEQ ID NO: 541536 - DNA, 496 bp, Homo sapiens
  misc_feature: HIJSMM301BUPQC.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggcctcccagattccagatgtgacatccagatcgacccagtcgccagcctccctgtctgcaagtgtgggagacagagtctacccttttttgccgggcgagtcggcccattgacgactgtttggcctggtatcgcgtgagaccagggcaaccccctcaacttctgatataccgttcatcgctgttgcacgttggggtcccacctcggttcagtggcaacggctctgagacagtatttttctctcgtcatcactggtctacagtctgacgacggcgcaatgtacttctgtcaacactatgcctctcccccctacaatttcggtcagggaccaagttgaacatcaatcgaactgtggctgcaccatctgtt

SEQ ID NO: 541537 - DNA, 383 bp, Homo sapiens; identical to SEQ ID NO: 447524
  misc_feature: HIJSMM301BCVB8.41.26.C04.1.454.light.4.raw

SEQ ID NO: 541538 - DNA, 479 bp, Homo sapiens
  misc_feature: HIJSMM301C384Y.48.51.E07.1.454.light.4.raw
agtatacatacacgaccggtgctcgatttagcatactctacaacacacaaagggggcaggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcaacctgaagattttgcaacttactactgtcaacagagttacagtgacccgtacaattttggccaggggaccaagctggagatcaaacgaactgt

SEQ ID NO: 541539 - DNA, 485 bp, Homo sapiens
  misc_feature: HIJSMM301A0JIO.3.10.A10.1.454.light.4.raw
agacgcactccacgaccggtgctcgatttagcgtcgatctcagggggctgtgggtccaggaggcagaactctgggtgtctcaccatggactggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 541540 - DNA, 444 bp, Homo sapiens; identical to SEQ ID NO: 535192
  misc_feature: HIJSMM301ESP4U.5.9.A09.1.454.light.4.raw

SEQ ID NO: 541541 - DNA, 480 bp, Homo sapiens
  misc_feature: HIJSMM301DKM0D.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggccctggaccaaagtggattccaacgaactgtggctgcaccatctgtcttcatcttcccgccatctgacactacta

SEQ ID NO: 541542 - DNA, 486 bp, Homo sapiens; identical to SEQ ID NO: 535043
  misc_feature: HIJSMM301BK06Q.46.35.D02.1.454.light.4.raw

SEQ ID NO: 541543 - DNA, 510 bp, Homo sapiens; identical to SEQ ID NO: 535855
  misc_feature: HIJSMM301AWJHJ.17.33.C11.1.454.light.4.raw

SEQ ID NO: 541544 - DNA, 494 bp, Homo sapiens; identical to SEQ ID NO: 539074
  misc_feature: HIJSMM301B79I9.51.35.D02.1.454.light.4.raw

SEQ ID NO: 541545 - DNA, 478 bp, Homo sapiens
  misc_feature: HIJSMM301BDASE.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttatactgtcagcagtatactaactggcctctgacgttcggccaagggaccagggtggaaatcaaacgaactgtggctgcaccat

SEQ ID NO: 541546 - DNA, 444 bp, Homo sapiens; identical to SEQ ID NO: 535594
  misc_feature: HIJSMM301EVDFU.9.9.A09.1.454.light.4.raw

SEQ ID NO: 541547 - DNA, 485 bp, Homo sapiens; identical to SEQ ID NO: 536630
  misc_feature: HIJSMM301BKGRY.13.56.F01.1.454.light.4.raw

SEQ ID NO: 541548 - DNA, 494 bp, Homo sapiens; identical to SEQ ID NO: 534992
  misc_feature: HIJSMM301D31G9.9.1.A01.1.454.light.4.raw

SEQ ID NO: 541549 - DNA, 511 bp, Homo sapiens
  misc_feature: HIJSMM301ANKG9.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 541550 - DNA, 472 bp, Homo sapiens; identical to SEQ ID NO: 535898
  misc_feature: HIJSMM301BZQ2F.15.8.A08.1.454.light.4.raw

SEQ ID NO: 541551 - DNA, 501 bp, Homo sapiens; identical to SEQ ID NO: 536818
  misc_feature: HIJSMM301CMZ0H.12.82.H05.1.454.light.4.raw

SEQ ID NO: 541552 - DNA, 497 bp, Homo sapiens
  misc_feature: HIJSMM301APXTX.48.82.H05.1.454.light.4.raw
agtatacatacacgaccggtgctcgatttagtcgagctctctcgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctcg

SEQ ID NO: 541553 - DNA, 506 bp, Homo sapiens
  misc_feature: HIJSMM301A6NB6.10.71.G05.1.454.light.4.raw
catagtagtgcacgaccggtgctcgatttagtgtcgtcgcaagagagagggggaggaactgctcagttaggacccacgagggaaccatggaagccccacgctcagcttctcttcctcctgctactctggctcccagacaccaccggagaaattgtgttgacacagtctccagccacgctgtctttgtctccaggggaaagagccaccctctcctgcaggaccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcgggagggaccaaaatagaggtacaacgaaactgtgctgcaccactctgtcttctat

SEQ ID NO: 541554 - DNA, 485 bp, Homo sapiens
  misc_feature: HIJSMM301B5B0A.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcac

SEQ ID NO: 541555 - DNA, 496 bp, Homo sapiens; identical to SEQ ID NO: 535541
  misc_feature: HIJSMM301AQ15G.3.33.C11.1.454.light.4.raw

SEQ ID NO: 541556 - DNA, 482 bp, Homo sapiens; identical to SEQ ID NO: 535920
  misc_feature: HIJSMM301DYKLV.19.71.G05.1.454.light.4.raw

SEQ ID NO: 541557 - DNA, 477 bp, Homo sapiens
  misc_feature: HIJSMM301C18XU.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtggggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactgtggctgcaccat

SEQ ID NO: 541558 - DNA, 466 bp, Homo sapiens
  misc_feature: HIJSMM301BEQQ8.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagacccccaaacctcatgatttatgatgtcactaatcggccctcagggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttccccaccctcctccatactcgta

SEQ ID NO: 541559 - DNA, 465 bp, Homo sapiens; identical to SEQ ID NO: 535060
  misc_feature: HIJSMM301BCG6F.3.20.B09.1.454.light.4.raw

SEQ ID NO: 541560 - DNA, 494 bp, Homo sapiens
  misc_feature: HIJSMM301C4U6R.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcat

SEQ ID NO: 541561 - DNA, 442 bp, Homo sapiens
  misc_feature: HIJSMM301DYZDR.11.3.A03.1.454.light.4.raw
cgagagataccacgaccggtgctcgatttagagagcgtcacagggtcctgggcccagtctgtgctgacgcagtccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 541562 - DNA, 504 bp, Homo sapiens
  misc_feature: HIJSMM301DJ6HX.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggccaaccccactgtca

SEQ ID NO: 541563 - DNA, 483 bp, Homo sapiens
  misc_feature: HIJSMM301CS3W5.8.5.A05.1.454.light.4.raw
ctcgcgtgtccacgaccggtgctcgatttagatagatagacaggggactgcgggggtaagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttggtacctacagggtatactggtaccaacagaagccagggagtcctccccagaatctcctggtatacaaatcagactcagataggcagcaggcctctggagtccccagccgcttctctggatccaaagatgcttcggccaatgcagggattttactcatctctgggctccagagtgacgatgaggctgactattactgtatgatttggcacaacagcgcttgggtgttcggcggagggaccaagctgaccctcctaggtcacg

SEQ ID NO: 541564 - DNA, 487 bp, Homo sapiens; identical to SEQ ID NO: 540557
  misc_feature: HIJSMM301AJ9F6.41.44.D11.1.454.light.4.raw

SEQ ID NO: 541565 - DNA, 486 bp, Homo sapiens; identical to SEQ ID NO: 535917
  misc_feature: HIJSMM301CBO9D.3.10.A10.1.454.light.4.raw

SEQ ID NO: 541566 - DNA, 517 bp, Homo sapiens
  misc_feature: HIJSMM301A0EQE.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgcctcctcacg

SEQ ID NO: 541567 - DNA, 490 bp, Homo sapiens
  misc_feature: HIJSMM301CSOFC.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcat

SEQ ID NO: 541568 - DNA, 354 bp, Homo sapiens; identical to SEQ ID NO: 535026
  misc_feature: HIJSMM301D9WDK.19.22.B11.1.454.light.4.raw

SEQ ID NO: 541569 - DNA, 494 bp, Homo sapiens
  misc_feature: HIJSMM301AG0Z8.49.66.F11.1.454.light.4.raw
agtcgagagacacgaccggtgctcgatttagtcacgcgagaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttctatcttcccg

SEQ ID NO: 541570 - DNA, 494 bp, Homo sapiens
  misc_feature: HIJSMM301BG5MD.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggccaagttggacatcaacgaactgtggctgca

SEQ ID NO: 541571 - DNA, 422 bp, Homo sapiens
  misc_feature: HIJSMM301B4UOB.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagtggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccaccctcctcagacgtatca

SEQ ID NO: 541572 - DNA, 485 bp, Homo sapiens; identical to SEQ ID NO: 535501
  misc_feature: HIJSMM301CS8YN.3.10.A10.1.454.light.4.raw

SEQ ID NO: 541573 - DNA, 491 bp, Homo sapiens
  misc_feature: HIJSMM301DA8VL.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccc

SEQ ID NO: 541574 - DNA, 502 bp, Homo sapiens
  misc_feature: HIJSMM301B601S.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggacctcgtcacggacgacgactgagataaacgaactagtggcgtgcaccactactgttcttctactcttccgt

SEQ ID NO: 541575 - DNA, 478 bp, Homo sapiens
  misc_feature: HIJSMM301BUDEM.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagatttgcaacttattactgtcaacaggtttatatttaccctcgtattttcggccctgggaccacagtagatatcaaacgaactgtggctgcacc

SEQ ID NO: 541576 - DNA, 520 bp, Homo sapiens
  misc_feature: HIJSMM301EQ3SV.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggaagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacgcg

SEQ ID NO: 541577 - DNA, 483 bp, Homo sapiens
  misc_feature: HIJSMM301ENCXT.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgactgtggctgcaccat

SEQ ID NO: 541578 - DNA, 441 bp, Homo sapiens; identical to SEQ ID NO: 534971
  misc_feature: HIJSMM301C9017.11.3.A03.1.454.light.4.raw

SEQ ID NO: 541579 - DNA, 502 bp, Homo sapiens
  misc_feature: HIJSMM301CJQN1.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaacggtaggagttactaacgaaactgtggcgtgcgaccactctgtcttctat

SEQ ID NO: 541580 - DNA, 492 bp, Homo sapiens
  misc_feature: HIJSMM301CI800.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaacgaactgtggctgcacatctgtctt

SEQ ID NO: 541581 - DNA, 454 bp, Homo sapiens; identical to SEQ ID NO: 534964
  misc_feature: HIJSMM301B6GBL.19.86.H09.1.454.light.4.raw

SEQ ID NO: 541582 - DNA, 447 bp, Homo sapiens; identical to SEQ ID NO: 535020
  misc_feature: HIJSMM301CCIPA.18.9.A09.1.454.light.4.raw

SEQ ID NO: 541583 - DNA, 487 bp, Homo sapiens
  misc_feature: HIJSMM301BLKJT.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 541584 - DNA, 500 bp, Homo sapiens
  misc_feature: HIJSMM301AECSQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaacgggaccgaaggtagggatatacagacgaactagttggc

SEQ ID NO: 541585 - DNA, 516 bp, Homo sapiens
  misc_feature: HIJSMM301ERAOL.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccgccctcctcagtcg

SEQ ID NO: 541586 - DNA, 481 bp, Homo sapiens; identical to SEQ ID NO: 535061
  misc_feature: HIJSMM301B902R.16.81.H04.1.454.light.4.raw

SEQ ID NO: 541587 - DNA, 497 bp, Homo sapiens; identical to SEQ ID NO: 535740
  misc_feature: HIJSMM301BJ79J.3.71.G05.1.454.light.4.raw

SEQ ID NO: 541588 - DNA, 491 bp, Homo sapiens
  misc_feature: HIJSMM301D0M64.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttttcagtggcagtggatctgggacagatttcactctcaccatcagcagtctgcaacctgaagattttgcaacttactactgtcaacagagttacaatacccctcggctcactttcggcggagggaccaaggtaggaggatcaaacgaaactgtggctgcacca

SEQ ID NO: 541589 - DNA, 505 bp, Homo sapiens
  misc_feature: HIJSMM301BUOO8.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctggt

SEQ ID NO: 541590 - DNA, 488 bp, Homo sapiens; identical to SEQ ID NO: 536554
  misc_feature: HIJSMM301AN9BF.26.37.D04.1.454.light.4.raw

SEQ ID NO: 541591 - DNA, 502 bp, Homo sapiens
  misc_feature: HIJSMM301B9KXZ.18.78.H01.1.454.light.4.raw
tacgagtatgcacgaccggtgctcgatttagtgtgagtagtttgggtttggggggctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 541592 - DNA, 501 bp, Homo sapiens; identical to SEQ ID NO: 536500
  misc_feature: HIJSMM301AYN9C.16.9.A09.1.454.light.4.raw

SEQ ID NO: 541593 - DNA, 489 bp, Homo sapiens; identical to SEQ ID NO: 535139
  misc_feature: HIJSMM301BVSTC.14.55.E11.1.454.light.4.raw

SEQ ID NO: 541594 - DNA, 486 bp, Homo sapiens
  misc_feature: HIJSMM301CQ2ST.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccacggggaccgaccggtggagtgtcaagcgaactgtggctgcaccat

SEQ ID NO: 541595 - DNA, 445 bp, Homo sapiens; identical to SEQ ID NO: 537719
  misc_feature: HIJSMM301EO848.47.85.H08.1.454.light.4.raw

SEQ ID NO: 541596 - DNA, 517 bp, Homo sapiens
  misc_feature: HIJSMM301CZYHO.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctgccccctcggtcactctgttcccaccctcctccacg

SEQ ID NO: 541597 - DNA, 421 bp, Homo sapiens
  misc_feature: HIJSMM301EXV02.41.82.H05.1.454.light.4.raw
tctatactatcacgaccggtgctcgatttagtcgagctctctcgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 541598 - DNA, 493 bp, Homo sapiens
  misc_feature: HIJSMM301A4O2U.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttatactgtcagcagcgtgagttctggcctccgctcactttcggcggagggaccagggtggagatcaaacgaactgtggctgcaccatctgtcttcatcc

SEQ ID NO: 541599 - DNA, 488 bp, Homo sapiens
  misc_feature: HIJSMM301ASSG7.10.33.C11.1.454.light.4.raw
  modified_base (466)..(466): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggtacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcacttcggcggggacgaacgtggagtcaacgaacngtggctgcaccatctcgtcttc

SEQ ID NO: 541600 - DNA, 503 bp, Homo sapiens
  misc_feature: HIJSMM301AZA6L.13.55.E11.1.454.light.4.raw
tcacgtactacacgaccggtgctcgatttagcactcgcacgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataatgtttttacccgggactctggggtcccagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgt

SEQ ID NO: 541601 - DNA, 505 bp, Homo sapiens
  misc_feature: HIJSMM301DA8OW.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccatgt

SEQ ID NO: 541602 - DNA, 486 bp, Homo sapiens; identical to SEQ ID NO: 536323
  misc_feature: HIJSMM301D8ZL7.10.2.A02.1.454.light.4.raw

SEQ ID NO: 541603 - DNA, 476 bp, Homo sapiens
  misc_feature: HIJSMM301EFXM4.52.19.B08.1.454.light.4.raw
cgcagtacgacacgaccggtgctcgatttagtgagtcagtaagggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcacca

SEQ ID NO: 541604 - DNA, 489 bp, Homo sapiens
  misc_feature: HIJSMM301A0RH8.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcctc

SEQ ID NO: 541605 - DNA, 481 bp, Homo sapiens; identical to SEQ ID NO: 535993
  misc_feature: HIJSMM301DY4SK.21.25.C03.1.454.light.4.raw

SEQ ID NO: 541606 - DNA, 493 bp, Homo sapiens
  misc_feature: HIJSMM301DN9IW.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcat

SEQ ID NO: 541607 - DNA, 484 bp, Homo sapiens
  misc_feature: HIJSMM301AX8I6.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacc

SEQ ID NO: 541608 - DNA, 447 bp, Homo sapiens; identical to SEQ ID NO: 535020
  misc_feature: HIJSMM301EDV91.18.9.A09.1.454.light.4.raw

SEQ ID NO: 541609 - DNA, 375 bp, Homo sapiens
  misc_feature: HIJSMM301EHKLE.43.46.E02.1.454.light.4.raw
tgtgagtagtcacgaccggtgctcgatttagactcatctacaggggaaagggccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 541610 - DNA, 489 bp, Homo sapiens
  misc_feature: HIJSMM301A5FU8.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatcccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccacttttggaaagtggggtcccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccat

SEQ ID NO: 541611 - DNA, 484 bp, Homo sapiens; identical to SEQ ID NO: 535240
  misc_feature: HIJSMM301EGONN.47.60.F05.1.454.light.4.raw

SEQ ID NO: 541612 - DNA, 487 bp, Homo sapiens
  misc_feature: HIJSMM301BO4GI.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagattcttcttaccctcggacgttcggccagggaccgacggtcggagtgtcaagcgaactcgtggctgcacca

SEQ ID NO: 541613 - DNA, 485 bp, Homo sapiens; identical to SEQ ID NO: 535606
  misc_feature: HIJSMM301DDQF5.47.46.E02.1.454.light.4.raw

SEQ ID NO: 541614 - DNA, 506 bp, Homo sapiens
  misc_feature: HIJSMM301CT8QH.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatcaaacgaactagtggctgcaccatctgt

SEQ ID NO: 541615 - DNA, 502 bp, Homo sapiens
  misc_feature: HIJSMM301D4QRU.21.26.C04.1.454.light.4.raw
tcgtcgctcgcacgaccggtgctcgatttagtctagcgactttgggtttggggagagaagagctgctcagttaggacccagagggaaccatggaaaccccagcgcagcttctcttcctcctgctactctggctcccagataccaccggagaaattgtgttgacgcagtctccggacaccctgtctttgtctccaggggaaagagccaccctctcctgcagggccagtcagattgttggcaacaactacttagcctggtaccagcagaaacctggccaggctcccaggctcctcatccatactgcctccaagagggccactggcatccctgacaggttcagtggcagtgggtctgggacagacttcactctcaccatcaccagactggagcctgatgattttgcagtttattactgccaccaacatgctttcgcaccgctcacgttcggcggagggaccagggtggagatcaaacgaactgtggctgcaccatctgtcttcat

SEQ ID NO: 541616 - DNA, 480 bp, Homo sapiens
  misc_feature: HIJSMM301EI9W3.21.25.C03.1.454.light.4.raw
tcgtcgctcgcacgaccggtgctcgatttagtagtgtagatttgggtttggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 541617 - DNA, 500 bp, Homo sapiens; identical to SEQ ID NO: 536480
  misc_feature: HIJSMM301AIDO8.16.9.A09.1.454.light.4.raw

SEQ ID NO: 541618 - DNA, 488 bp, Homo sapiens; identical to SEQ ID NO: 535081
  misc_feature: HIJSMM301CSKOS.26.23.C01.1.454.light.4.raw

SEQ ID NO: 541619 - DNA, 515 bp, Homo sapiens
  misc_feature: HIJSMM301CSU8O.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccgccctcctccactactatg

SEQ ID NO: 541620 - DNA, 506 bp, Homo sapiens; identical to SEQ ID NO: 535058
  misc_feature: HIJSMM301BINKL.17.41.D08.1.454.light.4.raw

SEQ ID NO: 541621 - DNA, 454 bp, Homo sapiens; identical to SEQ ID NO: 535005
  misc_feature: HIJSMM301DU2DI.19.86.H09.1.454.light.4.raw

SEQ ID NO: 541622 - DNA, 502 bp, Homo sapiens; identical to SEQ ID NO: 540449
  misc_feature: HIJSMM301EN8OD.10.71.G05.1.454.light.4.raw

SEQ ID NO: 541623 - DNA, 476 bp, Homo sapiens
  misc_feature: HIJSMM301B45WL.22.57.F02.1.454.light.4.raw
  modified_base (446)..(446): a, c, t, g, unknown or other
  modified_base (452)..(452): a, c, t, g, unknown or other
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaaacagcctgcagcctgatgatttggcaacttactactgcaaccgtatatactattgtcactcgcaggacagactagngataanaactagtgctgcaccactctgtct

SEQ ID NO: 541624 - DNA, 498 bp, Homo sapiens
  misc_feature: HIJSMM301CCW5Q.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggttccgtaatcgcttctctggctccaagtctggcgacacggcctccctcgaccatctctgggctccaggctgaagacgaggctgattattactgcagctcatatacaggcagcagcactcaggttttcggcggagggaccgaagctgaccgtcctaggtcagcccaaggctgccccctcggt

SEQ ID NO: 541625 - DNA, 497 bp, Homo sapiens; identical to SEQ ID NO: 535664
  misc_feature: HIJSMM301BDZDU.22.14.B03.1.454.light.4.raw

SEQ ID NO: 541626 - DNA, 501 bp, Homo sapiens; identical to SEQ ID NO: 538461
  misc_feature: HIJSMM301C7H37.13.11.A11.1.454.light.4.raw

SEQ ID NO: 541627 - DNA, 503 bp, Homo sapiens
  misc_feature: HIJSMM301B91UY.8.2.A02.1.454.light.4.raw
ctcgcgtgtccacgaccggtgctcgatttagactcatctacagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtgggaaatcaaacgaactagtggctgcacccatctgtcttcatcttcccgccat

SEQ ID NO: 541628 - DNA, 494 bp, Homo sapiens; identical to SEQ ID NO: 535629
  misc_feature: HIJSMM301AJKI2.4.27.C05.1.454.light.4.raw

SEQ ID NO: 541629 - DNA, 481 bp, Homo sapiens
  misc_feature: HIJSMM301ESEWI.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggaccgaagtggagatcaaacgaaactgtggctgcacc

SEQ ID NO: 541630 - DNA, 484 bp, Homo sapiens; identical to SEQ ID NO: 535240
  misc_feature: HIJSMM301CKHBJ.47.60.F05.1.454.light.4.raw

SEQ ID NO: 541631 - DNA, 496 bp, Homo sapiens; identical to SEQ ID NO: 535109
  misc_feature: HIJSMM301D45SP.16.78.H01.1.454.light.4.raw

SEQ ID NO: 541632 - DNA, 517 bp, Homo sapiens
  misc_feature: HIJSMM301DAQP0.49.26.C04.1.454.light.4.raw
agtcgagagacacgaccggtgctcgatttagtctagcgactttgggtttgggggtgggctcaggaggcagagctctgggaatctcaccatggcctggacccctctcctgctcccctcctcacttctgcacagtctctgaggcctcctatgagctgacacagccaccctcggtgtcggtgtcccacggacaaacggccaggataacctgctctggagatgcattgccaaaaaataatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgtcccaccctcctct

SEQ ID NO: 541633 - DNA, 454 bp, Homo sapiens; identical to SEQ ID NO: 534964
  misc_feature: HIJSMM301CWAQL.19.86.H09.1.454.light.4.raw

SEQ ID NO: 541634 - DNA, 514 bp, Homo sapiens
  misc_feature: HIJSMM301BRL41.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttcccta

SEQ ID NO: 541635 - DNA, 507 bp, Homo sapiens
  misc_feature: HIJSMM301ETQEN.4.57.F02.1.454.light.4.raw
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttccc

SEQ ID NO: 541636 - DNA, 504 bp, Homo sapiens; identical to SEQ ID NO: 536728
  misc_feature: HIJSMM301AMIBF.19.78.H01.1.454.light.4.raw

SEQ ID NO: 541637 - DNA, 517 bp, Homo sapiens
  misc_feature: HIJSMM301EJC7N.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggacgggaccgaaaactaagaaggtacgaaacgaaaccgtagtggcgtgcaccactactgtcttctat

SEQ ID NO: 541638 - DNA, 486 bp, Homo sapiens; identical to SEQ ID NO: 535290
  misc_feature: HIJSMM301AT6V0.3.12.B01.1.454.light.4.raw

SEQ ID NO: 541639 - DNA, 459 bp, Homo sapiens
  misc_feature: HIJSMM301EMIGD.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgta

SEQ ID NO: 541640 - DNA, 485 bp, Homo sapiens; identical to SEQ ID NO: 535985
  misc_feature: HIJSMM301CNKIZ.15.1.A01.1.454.light.4.raw

SEQ ID NO: 541641 - DNA, 499 bp, Homo sapiens
  misc_feature: HIJSMM301EXQST.51.80.H03.1.454.light.4.raw
cgatcgtatacacgaccggtgctcgatttagctgtgcgtcgaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgcccccc

SEQ ID NO: 541642 - DNA, 503 bp, Homo sapiens
  misc_feature: HIJSMM301EJ8ZR.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagtattttgctagtttattactgtcagcagcgtagcaactggcctcggacgttcggccgaacgggaaccgaacgtaggacgatacaagacgaacgtgtggctgcaccactctgtt

SEQ ID NO: 541643 - DNA, 503 bp, Homo sapiens
  misc_feature: HIJSMM301EOG15.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtcccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 541644 - DNA, 494 bp, Homo sapiens; identical to SEQ ID NO: 539784
  misc_feature: HIJSMM301DLRUT.22.57.F02.1.454.light.4.raw

SEQ ID NO: 541645 - DNA, 488 bp, Homo sapiens; identical to SEQ ID NO: 535861
  misc_feature: HIJSMM301B6CBT.14.55.E11.1.454.light.4.raw

SEQ ID NO: 541646 - DNA, 495 bp, Homo sapiens; identical to SEQ ID NO: 535596
  misc_feature: HIJSMM301AU3W5.10.79.H02.1.454.light.4.raw

SEQ ID NO: 541647 - DNA, 472 bp, Homo sapiens
  misc_feature: HIJSMM301BDMZH.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaaggctgaccgtcctgagtcagcccc

SEQ ID NO: 541648 - DNA, 465 bp, Homo sapiens; identical to SEQ ID NO: 541152
  misc_feature: HIJSMM301BH0CX.43.71.G05.1.454.light.4.raw

SEQ ID NO: 541649 - DNA, 520 bp, Homo sapiens
  misc_feature: HIJSMM301A3I4V.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaggaccgaaggtacggaagtacaagacgaacgtacgtggtcgtcgtcgaccaactctgttcttctacttcttcccgt

SEQ ID NO: 541650 - DNA, 492 bp, Homo sapiens
  misc_feature: HIJSMM301BRBHC.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 541651 - DNA, 495 bp, Homo sapiens
  misc_feature: HIJSMM301A4963.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagatttgcggtttattactgtcagcagtataataactggcctccacggtacacttttggccaggggaccaagctggagatcaaacgaactgtggctgcaccatctgt

SEQ ID NO: 541652 - DNA, 490 bp, Homo sapiens; identical to SEQ ID NO: 535936
  misc_feature: HIJSMM301AYC02.16.68.G02.1.454.light.4.raw

SEQ ID NO: 541653 - DNA, 499 bp, Homo sapiens
  misc_feature: HIJSMM301BI8NZ.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctc

SEQ ID NO: 541654 - DNA, 506 bp, Homo sapiens; identical to SEQ ID NO: 534969
  misc_feature: HIJSMM301BDT7N.18.37.D04.1.454.light.4.raw

SEQ ID NO: 541655 - DNA, 444 bp, Homo sapiens; identical to SEQ ID NO: 535042
  misc_feature: HIJSMM301B91F7.10.76.G10.1.454.light.4.raw

SEQ ID NO: 541656 - DNA, 484 bp, Homo sapiens; identical to SEQ ID NO: 535211
  misc_feature: HIJSMM301EL19Y.47.46.E02.1.454.light.4.raw

SEQ ID NO: 541657 - DNA, 493 bp, Homo sapiens; identical to SEQ ID NO: 535047
  misc_feature: HIJSMM301BLG7L.16.53.E09.1.454.light.4.raw

SEQ ID NO: 541658 - DNA, 494 bp, Homo sapiens; identical to SEQ ID NO: 534992
  misc_feature: HIJSMM301AR8FA.9.1.A01.1.454.light.4.raw

SEQ ID NO: 541659 - DNA, 490 bp, Homo sapiens; identical to SEQ ID NO: 535234
  misc_feature: HIJSMM301DVJT3.17.21.B10.1.454.light.4.raw

SEQ ID NO: 541660 - DNA, 454 bp, Homo sapiens; identical to SEQ ID NO: 535005
  misc_feature: HIJSMM301C6USE.19.86.H09.1.454.light.4.raw

SEQ ID NO: 541661 - DNA, 444 bp, Homo sapiens; identical to SEQ ID NO: 535594
  misc_feature: HIJSMM301BYOY1.9.9.A09.1.454.light.4.raw

SEQ ID NO: 541662 - DNA, 484 bp, Homo sapiens; identical to SEQ ID NO: 535400
  misc_feature: HIJSMM301BC2EY.46.26.C04.1.454.light.4.raw

SEQ ID NO: 541663 - DNA, 485 bp, Homo sapiens; identical to SEQ ID NO: 535985
  misc_feature: HIJSMM301AMP1X.15.1.A01.1.454.light.4.raw

SEQ ID NO: 541664 - DNA, 495 bp, Homo sapiens
  misc_feature: HIJSMM301DO4E0.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctacccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 541665 - DNA, 515 bp, Homo sapiens
  misc_feature: HIJSMM301B71PC.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtaggaaagtacaagacgaacgtagtggcgtcgcaccactctgtcttctactcttcccgt

SEQ ID NO: 541666 - DNA, 520 bp, Homo sapiens
  misc_feature: HIJSMM301BELYJ.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgccctcctcat

SEQ ID NO: 541667 - DNA, 488 bp, Homo sapiens
  misc_feature: HIJSMM301DBB8O.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcgcggaggaccgaagaggagatcaaacgaactaagtgctgcaccactct

SEQ ID NO: 541668 - DNA, 460 bp, Homo sapiens; identical to SEQ ID NO: 536053
  misc_feature: HIJSMM301DARAW.22.28.C06.1.454.light.4.raw

SEQ ID NO: 541669 - DNA, 496 bp, Homo sapiens; identical to SEQ ID NO: 535109
  misc_feature: HIJSMM301A4N0P.16.78.H01.1.454.light.4.raw

SEQ ID NO: 541670 - DNA, 478 bp, Homo sapiens
  misc_feature: HIJSMM301CJSA8.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaa

SEQ ID NO: 541671 - DNA, 495 bp, Homo sapiens
  misc_feature: HIJSMM301BQQ8V.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaactgtggctgcaccatctgtcttcatattcccg

SEQ ID NO: 541672 - DNA, 494 bp, Homo sapiens; identical to SEQ ID NO: 534992
  misc_feature: HIJSMM301APICR.9.1.A01.1.454.light.4.raw

SEQ ID NO: 541673 - DNA, 480 bp, Homo sapiens
  misc_feature: HIJSMM301BOE0S.48.24.C02.1.454.light.4.raw
agtatacatacacgaccggtgctcgatttagtacagatcgttagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcagggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcaga

SEQ ID NO: 541674 - DNA, 493 bp, Homo sapiens
  misc_feature: HIJSMM301EBYWK.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaaatcaacagacaccattggtacttatgtcttcggaactgcgaccaaaggtcaccgtcctgggtcagcccaaggccaacccactgtcact

SEQ ID NO: 541675 - DNA, 477 bp, Homo sapiens
  misc_feature: HIJSMM301C1X5X.49.87.H10.1.454.light.4.raw
agtcgagagacacgaccggtgctcgatttagcagtactgcgttgggtttgggggcaggagtcagtcccaaccaggacacagcatggacatgagggtccctgctcagctcctggggctcctgctactctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagatattgcaacatattactgtcaacagtatgatagtctccgctcactttcggcgggggaccgaaggtggagatcaagcgaactgtgg

SEQ ID NO: 541676 - DNA, 497 bp, Homo sapiens
  misc_feature: HIJSMM301DT04C.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggttattactgcatgcaaggtctacaaaccccgatcaccttcggccgagggacacgcctggagattaaacgaactgtggctgcaccat

SEQ ID NO: 541677 - DNA, 484 bp, Homo sapiens; identical to SEQ ID NO: 540581
  misc_feature: HIJSMM301BKNMW.3.88.H11.1.454.light.4.raw

SEQ ID NO: 541678 - DNA, 489 bp, Homo sapiens
  misc_feature: HIJSMM301AVB5N.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcaggggccactggcatcccaggcagattcagtggcagtgggtctgggacagacttcactctcacccatcagcagactggagcctgaagattttgtcagtctattactgtcagcagtatggtcacgtcccaagaactttggtccagggaccgaagctggagatcaaacgaactgtggctgcaccat

SEQ ID NO: 541679 - DNA, 521 bp, Homo sapiens; identical to SEQ ID NO: 538715
  misc_feature: HIJSMM301C61L6.27.23.C01.1.454.light.4.raw

SEQ ID NO: 541680 - DNA, 503 bp, Homo sapiens; identical to SEQ ID NO: 535140
  misc_feature: HIJSMM301BMV2J.18.37.D04.1.454.light.4.raw

SEQ ID NO: 541681 - DNA, 519 bp, Homo sapiens
  misc_feature: HIJSMM301DFHU1.27.23.C01.1.454.light.4.raw
agcgtcgtctcacgaccggtgctcgatttagtacacgtgattagggattgggggggtctcaggaggcagcgctctcgggacgtctccgccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 541682 - DNA, 507 bp, Homo sapiens
  misc_feature: HIJSMM301DWABE.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggccccaggcagatgatgagtgtgattattactgtgtgctctatatgggcagtggcgtttgggtgttcggcggagggaccaagctgaccgttc

SEQ ID NO: 541683 - DNA, 466 bp, Homo sapiens; identical to SEQ ID NO: 535366
  misc_feature: HIJSMM301BQQJS.13.4.A04.1.454.light.4.raw

SEQ ID NO: 541684 - DNA, 495 bp, Homo sapiens
  misc_feature: HIJSMM301ANA0B.27.78.H01.1.454.light.4.raw
  modified_base (482)..(482): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgnacccatctgtctt

SEQ ID NO: 541685 - DNA, 516 bp, Homo sapiens
  misc_feature: HIJSMM301AJPFS.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccaccctcctct

SEQ ID NO: 541686 - DNA, 483 bp, Homo sapiens; identical to SEQ ID NO: 539101
  misc_feature: HIJSMM301EL1FM.14.53.E09.1.454.light.4.raw

SEQ ID NO: 541687 - DNA, 490 bp, Homo sapiens; identical to SEQ ID NO: 535420
  misc_feature: HIJSMM301CUMTA.3.72.G06.1.454.light.4.raw

SEQ ID NO: 541688 - DNA, 504 bp, Homo sapiens; identical to SEQ ID NO: 535561
  misc_feature: HIJSMM301B35VT.4.57.F02.1.454.light.4.raw

SEQ ID NO: 541689 - DNA, 494 bp, Homo sapiens; identical to SEQ ID NO: 534994
  misc_feature: HIJSMM301CEBRY.27.78.H01.1.454.light.4.raw

SEQ ID NO: 541690 - DNA, 515 bp, Homo sapiens
  misc_feature: HIJSMM301BK4MF.15.86.H09.1.454.light.4.raw
  modified_base (496)..(496): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttccccnccctcctcgctacgtagac

SEQ ID NO: 541691 - DNA, 498 bp, Homo sapiens
  misc_feature: HIJSMM301CMXYB.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcactatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 541692 - DNA, 476 bp, Homo sapiens
  misc_feature: HIJSMM301BVUOL.48.60.F05.1.454.light.4.raw
agtatacatacacgaccggtgctcgatttagtacgtcatcagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcagggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcc

SEQ ID NO: 541693 - DNA, 501 bp, Homo sapiens; identical to SEQ ID NO: 536818
  misc_feature: HIJSMM301BIO9A.12.82.H05.1.454.light.4.raw

SEQ ID NO: 541694 - DNA, 490 bp, Homo sapiens; identical to SEQ ID NO: 535526
  misc_feature: HIJSMM301DH1G1.26.78.H01.1.454.light.4.raw

SEQ ID NO: 541695 - DNA, 521 bp, Homo sapiens
  misc_feature: HIJSMM301CTR14.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacactgggtgttcggcggagggaccaggctgaccgtcctaggtcagcccaaggctgccccctccggtcactctgttcccgccct

SEQ ID NO: 541696 - DNA, 494 bp, Homo sapiens; identical to SEQ ID NO: 534992
  misc_feature: HIJSMM301BBL4Y.9.1.A01.1.454.light.4.raw

SEQ ID NO: 541697 - DNA, 445 bp, Homo sapiens
  misc_feature: HIJSMM301B6402.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaaccctctgtcactctgttcccgccctcctccatactcgta

SEQ ID NO: 541698 - DNA, 486 bp, Homo sapiens; identical to SEQ ID NO: 535917
  misc_feature: HIJSMM301BAO7A.3.10.A10.1.454.light.4.raw

SEQ ID NO: 541699 - DNA, 485 bp, Homo sapiens; identical to SEQ ID NO: 536040
  misc_feature: HIJSMM301B7LUE.15.1.A01.1.454.light.4.raw

SEQ ID NO: 541700 - DNA, 494 bp, Homo sapiens; identical to SEQ ID NO: 534992
  misc_feature: HIJSMM301AY51U.9.1.A01.1.454.light.4.raw

SEQ ID NO: 541701 - DNA, 499 bp, Homo sapiens
  misc_feature: HIJSMM301EDAFX.41.53.E09.1.454.light.4.raw
  modified_base (481)..(481): a, c, t, g, unknown or other
tctatactatcacgaccggtgctcgatttagagagagtgtgttgggtttggggctttgcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattactactgcttctcatatgcagatactaaagtcctgggtgttcggcggagggaccaagctgaccgtcctaggtcagcccaaggctgccccctcggtcactctgttcccnccctcctcatagtataga

SEQ ID NO: 541702 - DNA, 489 bp, Homo sapiens
  misc_feature: HIJSMM301BVKG8.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 541703 - DNA, 441 bp, Homo sapiens; identical to SEQ ID NO: 534971
  misc_feature: HIJSMM301EFK4E.11.3.A03.1.454.light.4.raw

SEQ ID NO: 541704 - DNA, 520 bp, Homo sapiens; identical to SEQ ID NO: 538570
  misc_feature: HIJSMM301DB0ZB.27.23.C01.1.454.light.4.raw

SEQ ID NO: 541705 - DNA, 479 bp, Homo sapiens; identical to SEQ ID NO: 535118
  misc_feature: HIJSMM301EO1W3.13.59.F04.1.454.light.4.raw

SEQ ID NO: 541706 - DNA, 444 bp, Homo sapiens; identical to SEQ ID NO: 535027
  misc_feature: HIJSMM301DTZS9.8.73.G07.1.454.light.4.raw

SEQ ID NO: 541707 - DNA, 470 bp, Homo sapiens; identical to SEQ ID NO: 536130
  misc_feature: HIJSMM301CL8K1.7.81.H04.1.454.light.4.raw

SEQ ID NO: 541708 - DNA, 483 bp, Homo sapiens
  misc_feature: HIJSMM301CA2TR.43.50.E06.1.454.light.4.raw
tgtgagtagtcacgaccggtgctcgatttagatctactgacaacacacaagggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaacgaactgtggctgcacc

SEQ ID NO: 541709 - DNA, 487 bp, Homo sapiens; identical to SEQ ID NO: 539157
  misc_feature: HIJSMM301CXUM6.26.37.D04.1.454.light.4.raw

SEQ ID NO: 541710 - DNA, 445 bp, Homo sapiens
  misc_feature: HIJSMM301DZN2L.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccgccctcctccactactatg

SEQ ID NO: 541711 - DNA, 488 bp, Homo sapiens; identical to SEQ ID NO: 536554
  misc_feature: HIJSMM301EMCWP.26.37.D04.1.454.light.4.raw

SEQ ID NO: 541712 - DNA, 483 bp, Homo sapiens; identical to SEQ ID NO: 535413
  misc_feature: HIJSMM301AW2JI.26.78.H01.1.454.light.4.raw

SEQ ID NO: 541713 - DNA, 494 bp, Homo sapiens; identical to SEQ ID NO: 534994
  misc_feature: HIJSMM301CMRM9.27.78.H01.1.454.light.4.raw

SEQ ID NO: 541714 - DNA, 488 bp, Homo sapiens
  misc_feature: HIJSMM301DXIO1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 541715 - DNA, 498 bp, Homo sapiens
  misc_feature: HIJSMM301AGFVD.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactgaccgtcctaggtcagcccaaggctgccccctccggtcactctgttcccc

SEQ ID NO: 541716 - DNA, 500 bp, Homo sapiens
  misc_feature: HIJSMM301DRRD2.5.86.H09.1.454.light.4.raw
atcagacacgcacgaccggtgctcgatttagtgctatagacttgggtttggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 541717 - DNA, 509 bp, Homo sapiens; identical to SEQ ID NO: 539269
  misc_feature: HIJSMM301A76J3.4.57.F02.1.454.light.4.raw

SEQ ID NO: 541718 - DNA, 502 bp, Homo sapiens
  misc_feature: HIJSMM301CP9M3.49.82.H05.1.454.light.4.raw
agtcgagagacacgaccggtgctcgatttagtcgagctctctcgcgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccgtcctaggtcagcccaaggctgcccctcggt

SEQ ID NO: 541719 - DNA, 509 bp, Homo sapiens
  misc_feature: HIJSMM301AH840.8.19.B08.1.454.light.4.raw
ctcgcgtgtccacgaccggtgctcgatttagtgagtcagtaagggggaggaactgctcagttaggacccagagggaaccatggaagccccacgctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaattgagatcaaacgaactgtggctgcaccatctgtcttctatcttcccgccact

SEQ ID NO: 541720 - DNA, 511 bp, Homo sapiens
  misc_feature: HIJSMM301BA5VR.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctcg

SEQ ID NO: 541721 - DNA, 489 bp, Homo sapiens; identical to SEQ ID NO: 535139
  misc_feature: HIJSMM301EIYW7.14.55.E11.1.454.light.4.raw

SEQ ID NO: 541722 - DNA, 504 bp, Homo sapiens
  misc_feature: HIJSMM301A13KA.48.34.D01.1.454.light.4.raw
agtatacatacacgaccggtgctcgatttagatcgtctgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 541723 - DNA, 505 bp, Homo sapiens
  misc_feature: HIJSMM301CVO90.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgcccccc

SEQ ID NO: 541724 - DNA, 486 bp, Homo sapiens; identical to SEQ ID NO: 535917
  misc_feature: HIJSMM301DQIZH.3.10.A10.1.454.light.4.raw

SEQ ID NO: 541725 - DNA, 494 bp, Homo sapiens; identical to SEQ ID NO: 534992
  misc_feature: HIJSMM301D2JIC.9.1.A01.1.454.light.4.raw

SEQ ID NO: 541726 - DNA, 446 bp, Homo sapiens
  misc_feature: HIJSMM301DPVGW.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagccaaggccaacccctctgtcactctgttcccgccctcctccatactcgta

SEQ ID NO: 541727 - DNA, 447 bp, Homo sapiens
  misc_feature: HIJSMM301A5JNH.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccatcctcctccatactcgta

SEQ ID NO: 541728 - DNA, 496 bp, Homo sapiens
  misc_feature: HIJSMM301DI3MV.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtggggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 541729 - DNA, 487 bp, Homo sapiens
  misc_feature: HIJSMM301BF9ZY.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagccccg

SEQ ID NO: 541730 - DNA, 482 bp, Homo sapiens
  misc_feature: HIJSMM301DVTCW.48.33.C11.1.454.light.4.raw
agtatacatacacgaccggtgctcgatttagagtgagctcgttgggtttgggggagtcagacccactcaggacacagcatggacatgagggtccccgctcagctcctggggctcctgctgctctgactcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacattaccctcggacgttcgccaaggaccgaaggtggaagtcaaacgaactagtggctgcacca

SEQ ID NO: 541731 - DNA, 505 bp, Homo sapiens; identical to SEQ ID NO: 541350
  misc_feature: HIJSMM301AX8NU.2.71.G05.1.454.light.4.raw

SEQ ID NO: 541732 - DNA, 497 bp, Homo sapiens; identical to SEQ ID NO: 541552
  misc_feature: HIJSMM301B1CI3.48.82.H05.1.454.light.4.raw

SEQ ID NO: 541733 - DNA, 493 bp, Homo sapiens
  misc_feature: HIJSMM301AKTVJ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtaggacgatcaagcgaactagtggctgcaccatct

SEQ ID NO: 541734 - DNA, 487 bp, Homo sapiens
  misc_feature: HIJSMM301DJPT1.51.14.B03.1.454.light.4.raw
cgatcgtatacacgaccggtgctcgatttagtgtgagtagttccgcggggatcacaccctgtgcaggagtcagaccccgtccaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcgagggaccaaggtagaaaccaacgaactgtgg

SEQ ID NO: 541735 - DNA, 497 bp, Homo sapiens; identical to SEQ ID NO: 535740
  misc_feature: HIJSMM301EZBND.3.71.G05.1.454.light.4.raw

SEQ ID NO: 541736 - DNA, 507 bp, Homo sapiens; identical to SEQ ID NO: 535641
  misc_feature: HIJSMM301C2N20.10.88.H11.1.454.light.4.raw

SEQ ID NO: 541737 - DNA, 505 bp, Homo sapiens; identical to SEQ ID NO: 536254
  misc_feature: HIJSMM301EFKBT.7.71.G05.1.454.light.4.raw

SEQ ID NO: 541738 - DNA, 488 bp, Homo sapiens; identical to SEQ ID NO: 541295
  misc_feature: HIJSMM301DVZ7O.9.59.F04.1.454.light.4.raw

SEQ ID NO: 541739 - DNA, 505 bp, Homo sapiens
  misc_feature: HIJSMM301BOY49.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccccctcgaggttcagtggcagtggatctgggacacattttcaccctcaccatcaatagcctggaagctgaagatgctgcaacttattactgtcatcagagtactactttacctcaagtgatcaccttcggccaagggacacgactggagattaaacg

SEQ ID NO: 541740 - DNA, 459 bp, Homo sapiens
  misc_feature: HIJSMM301A7W9A.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtagt

SEQ ID NO: 541741 - DNA, 509 bp, Homo sapiens
  misc_feature: HIJSMM301BV06K.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaggaccaacggtaggaagtcaaacgaactagtggcgtgcaccatctgtcttctatcttcccgcccact

SEQ ID NO: 541742 - DNA, 447 bp, Homo sapiens
  misc_feature: HIJSMM301EL8TD.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagtccaaggccaacccctctgtcactctgttcccgccctcctccatactcgta

SEQ ID NO: 541743 - DNA, 385 bp, Homo sapiens
  misc_feature: HIJSMM301EM46Q.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaaactgtggctgcaccatctgtcttcatcttcccgccatctgaatagtatagaa

SEQ ID NO: 541744 - DNA, 482 bp, Homo sapiens
  misc_feature: HIJSMM301BEETP.41.15.B04.1.454.light.4.raw
tctatactatcacgaccggtgctcgatttagacagtatatatccgcgggggagtcagtctcagtcaggacacagcatggacatgagggtccccgctcagctcctggggctcctgctactctggctccgaggtgccagatgtgacatccagatgacccagtctccatcctccctgtctgcatctataggagacagagtcaccatcacttgccgggcaaatcagaacattattagatatttaaattggtatcatcacaaaccagggaaagcccctaagctcctgatctatgctgcatccaatttgcaaagtgggtcccgtcaaggttcagtggcagtggatctgggacagatttcactctcaccatcagcagtctgcaacctgaagattttgcaacttactactgtcaacagacttacagtgcccctcggaccaccttcggccaagggacacgactggacattaaacgaactgtggctgcacca

SEQ ID NO: 541745 - DNA, 450 bp, Homo sapiens
  misc_feature: HIJSMM301A49N4.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactacctcatctttggtagcaacaatcggccctcaggggtcccgtcgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 541746 - DNA, 518 bp, Homo sapiens
  misc_feature: HIJSMM301CSZ1X.41.19.B08.1.454.light.4.raw
tctatactatcacgaccggtgctcgatttagtgagtcagtaaggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccacctcct

SEQ ID NO: 541747 - DNA, 492 bp, Homo sapiens
  misc_feature: HIJSMM301B6CGW.19.71.G05.1.454.light.4.raw
tactctcgtgcacgaccggtgctcgatttagtgtcgtcgcaagagagagggggacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 541748 - DNA, 494 bp, Homo sapiens
  misc_feature: HIJSMM301EHC9E.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggcccctgggaccagagtggatatcaaacgaactgtggctgcaccatctgtcttcatcttcccg

SEQ ID NO: 541749 - DNA, 491 bp, Homo sapiens; identical to SEQ ID NO: 538388
  misc_feature: HIJSMM301DSWPL.51.81.H04.1.454.light.4.raw

SEQ ID NO: 541750 - DNA, 494 bp, Homo sapiens; identical to SEQ ID NO: 534992
  misc_feature: HIJSMM301DCCU0.9.1.A01.1.454.light.4.raw

SEQ ID NO: 541751 - DNA, 510 bp, Homo sapiens
  misc_feature: HIJSMM301DFQXE.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggcctgcccccc

SEQ ID NO: 541752 - DNA, 496 bp, Homo sapiens
  misc_feature: HIJSMM301A2FL3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggcctacgatacgaacgtgacaaaggtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattaatacttcgtggacgttcggccaagggaccaaaggtggataatcagagaa

SEQ ID NO: 541753 - DNA, 481 bp, Homo sapiens; identical to SEQ ID NO: 540702
  misc_feature: HIJSMM301A9JMJ.13.8.A08.1.454.light.4.raw

SEQ ID NO: 541754 - DNA, 486 bp, Homo sapiens; identical to SEQ ID NO: 535043
  misc_feature: HIJSMM301AIEH9.46.35.D02.1.454.light.4.raw

SEQ ID NO: 541755 - DNA, 487 bp, Homo sapiens
  misc_feature: HIJSMM301D23ZE.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcat

SEQ ID NO: 541756 - DNA, 496 bp, Homo sapiens
  misc_feature: HIJSMM301A2568.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggaggatcaaccgaactgtggctgcaccatctgtt

SEQ ID NO: 541757 - DNA, 493 bp, Homo sapiens; identical to SEQ ID NO: 539202
  misc_feature: HIJSMM301BOOIZ.22.57.F02.1.454.light.4.raw

SEQ ID NO: 541758 - DNA, 488 bp, Homo sapiens
  misc_feature: HIJSMM301BEOE2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaattcttttatacagttccaacaatagaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 541759 - DNA, 501 bp, Homo sapiens; identical to SEQ ID NO: 537545
  misc_feature: HIJSMM301ESKOJ.49.69.G03.1.454.light.4.raw

SEQ ID NO: 541760 - DNA, 508 bp, Homo sapiens
  misc_feature: HIJSMM301AR2VC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacaaacgaactagtggctgcaccatctgtcttcatcttccccg

SEQ ID NO: 541761 - DNA, 478 bp, Homo sapiens
  misc_feature: HIJSMM301BE4AG.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccagggaccaagctggagatcaacgaa

SEQ ID NO: 541762 - DNA, 484 bp, Homo sapiens; identical to SEQ ID NO: 538094
  misc_feature: HIJSMM301CUHK4.3.10.A10.1.454.light.4.raw

SEQ ID NO: 541763 - DNA, 497 bp, Homo sapiens
  misc_feature: HIJSMM301EQSRQ.14.59.F04.1.454.light.4.raw
  modified_base (474)..(474): a, c, t, g, unknown or other
cgtctagtaccacgaccggtgctcgatttagtacacacacttagggattgggggatcaggactcctcagttcaccttctcacaatgaggctccctgctcagctcctggggctgctaatgctctgggtctctggatccagtggggatattgtgatgactcagtctccactttccctgaccgtcacccctggagagccggcctccatctcctgcaggtctagtcagagcctcctgcatactaatggaaacaactttttggattggtacctgcagaagccagggcagtctccacagctcctgatctatttgggttctaatcgggcctccggagtccctgacaggttcagtggcagtggatcaggcacagattttacactgaaaaatcagcagagtggaggctgaggatgttggggtttattactgcatgcaagctctacaaactcgaacgttcgcaacggaccgaagtaggaaaganaaaccgaaatgtgctgcaccaat

SEQ ID NO: 541764 - DNA, 506 bp, Homo sapiens
  misc_feature: HIJSMM301CG739.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccgccct

SEQ ID NO: 541765 - DNA, 466 bp, Homo sapiens
  misc_feature: HIJSMM301BIOU1.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatac

SEQ ID NO: 541766 - DNA, 503 bp, Homo sapiens
  misc_feature: HIJSMM301AROGZ.49.73.G07.1.454.light.4.raw
agtcgagagacacgaccggtgctcgatttagctctacgctcagggcacgaccggtgctcgatttagagagagtgtgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcct

SEQ ID NO: 541767 - DNA, 485 bp, Homo sapiens; identical to SEQ ID NO: 536075
  misc_feature: HIJSMM301D0VUS.17.21.B10.1.454.light.4.raw

SEQ ID NO: 541768 - DNA, 503 bp, Homo sapiens
  misc_feature: HIJSMM301BF131.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcacgacccgaagctcgcccccgtcggtaccactctcgttcccca

SEQ ID NO: 541769 - DNA, 500 bp, Homo sapiens
  misc_feature: HIJSMM301C2RH1.47.38.D05.1.454.light.4.raw
agctcacgtacacgaccggtgctcgatttagtatctgatagttgggtttggggtgatcaggactcctcagttcaccttctcacaatgaggctccctgctcagctccgtggggctgctaatgctctgggtctctggatccaggtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctagaaaatcagtagggtggaggctgaggatgttggggtttattactgcatgcaagttctacaaacttcctactacttttggccaggggaccaagctggagatcaaacgaactgtggctgcaa

SEQ ID NO: 541770 - DNA, 494 bp, Homo sapiens; identical to SEQ ID NO: 535828
  misc_feature: HIJSMM301AS4M5.3.36.D03.1.454.light.4.raw

SEQ ID NO: 541771 - DNA, 493 bp, Homo sapiens
  misc_feature: HIJSMM301AOIY3.43.35.D02.1.454.light.4.raw
tgtgagtagtcacgaccggtgctcgatttagcacacgatagttgggtttggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaaggaccaacgtggaaatcaacgaaactgtggctgcaccatctgtcttcatt

SEQ ID NO: 541772 - DNA, 496 bp, Homo sapiens
  misc_feature: HIJSMM301D3Q0B.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 541773 - DNA, 494 bp, Homo sapiens; identical to SEQ ID NO: 534994
  misc_feature: HIJSMM301CJOYC.27.78.H01.1.454.light.4.raw

SEQ ID NO: 541774 - DNA, 471 bp, Homo sapiens; identical to SEQ ID NO: 537461
  misc_feature: HIJSMM301EC9SI.7.81.H04.1.454.light.4.raw

SEQ ID NO: 541775 - DNA, 517 bp, Homo sapiens
  misc_feature: HIJSMM301BR85V.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgt

SEQ ID NO: 541776 - DNA, 507 bp, Homo sapiens
  misc_feature: HIJSMM301A07PG.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtccaccgtcctaggtcagccccaaggcccaaccccactgtcta

SEQ ID NO: 541777 - DNA, 460 bp, Homo sapiens; identical to SEQ ID NO: 537107
  misc_feature: HIJSMM301EIQLN.22.28.C06.1.454.light.4.raw

SEQ ID NO: 541778 - DNA, 481 bp, Homo sapiens
  misc_feature: HIJSMM301CV42S.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaactattactgcaacagtataatgtatgaatccactttgtcaaggaccaagctgagatcaaacgaaactgtgctgcacca

SEQ ID NO: 541779 - DNA, 486 bp, Homo sapiens; identical to SEQ ID NO: 535458
  misc_feature: HIJSMM301A6MO5.7.75.G09.1.454.light.4.raw

SEQ ID NO: 541780 - DNA, 508 bp, Homo sapiens
  misc_feature: HIJSMM301B08WU.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggagggaccaggctgaccgtcctaagtcagcccaaggctgccccctc

SEQ ID NO: 541781 - DNA, 463 bp, Homo sapiens; identical to SEQ ID NO: 535062
  misc_feature: HIJSMM301A2CGI.11.73.G07.1.454.light.4.raw

SEQ ID NO: 541782 - DNA, 444 bp, Homo sapiens; identical to SEQ ID NO: 535027
  misc_feature: HIJSMM301APOJZ.8.73.G07.1.454.light.4.raw

SEQ ID NO: 541783 - DNA, 490 bp, Homo sapiens; identical to SEQ ID NO: 538361
  misc_feature: HIJSMM301AXG0J.47.55.E11.1.454.light.4.raw

SEQ ID NO: 541784 - DNA, 493 bp, Homo sapiens; identical to SEQ ID NO: 535745
  misc_feature: HIJSMM301EK85M.47.78.H01.1.454.light.4.raw

SEQ ID NO: 541785 - DNA, 452 bp, Homo sapiens
  misc_feature: HIJSMM301CR39U.19.86.H09.1.454.light.4.raw
tactctcgtgcacgaccggtgctcgatttagtgctatagacttgggtttggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 541786 - DNA, 496 bp, Homo sapiens
  misc_feature: HIJSMM301EGKJG.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacacttttggccaggggaccaagctggagatcaaacgaactagtggc

SEQ ID NO: 541787 - DNA, 385 bp, Homo sapiens; identical to SEQ ID NO: 539030
  misc_feature: HIJSMM301AWCVS.49.34.D01.1.454.light.4.raw

SEQ ID NO: 541788 - DNA, 454 bp, Homo sapiens; identical to SEQ ID NO: 536347
  misc_feature: HIJSMM301CM1TG.19.86.H09.1.454.light.4.raw

SEQ ID NO: 541789 - DNA, 493 bp, Homo sapiens
  misc_feature: HIJSMM301BTCB2.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccagggacccaggtggagatcagacgaactgtggctgcaccatctgtcttcatcttcccg

SEQ ID NO: 541790 - DNA, 497 bp, Homo sapiens
  misc_feature: HIJSMM301C48F0.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggaggatcaaacgaactgtggcgtgcaccatctgtcttcatt

SEQ ID NO: 541791 - DNA, 500 bp, Homo sapiens
  misc_feature: HIJSMM301EYO82.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctcgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaa

SEQ ID NO: 541792 - DNA, 518 bp, Homo sapiens
  misc_feature: HIJSMM301AK2UC.52.58.F03.1.454.light.4.raw
cgcagtacgacacgaccggtgctcgatttagtctgatcgagaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattacttgcagctcatatacaaacagaaacaacttggtgttcggcggcgggaccgaaactagaccgtcctaccgtcagcccaacggctgccccctccggtccgta

SEQ ID NO: 541793 - DNA, 495 bp, Homo sapiens
  misc_feature: HIJSMM301EOC1W.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcacccatctgtctt

SEQ ID NO: 541794 - DNA, 493 bp, Homo sapiens; identical to SEQ ID NO: 535745
  misc_feature: HIJSMM301B9CZ7.47.78.H01.1.454.light.4.raw

SEQ ID NO: 541795 - DNA, 507 bp, Homo sapiens
  misc_feature: HIJSMM301DHUNW.48.37.D04.1.454.light.4.raw
agtatacatacacgaccggtgctcgatttagtagcatactgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccta

SEQ ID NO: 541796 - DNA, 418 bp, Homo sapiens
  misc_feature: HIJSMM301DP63K.41.9.A09.1.454.light.4.raw
tctatactatcacgaccggtgctcgatttagcgagacgcgcagggcacgaccggtgctcgatttagtgtgagtagtttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 541797 - DNA, 510 bp, Homo sapiens
  misc_feature: HIJSMM301CTJMM.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctgttcccgccctcctcgctacgtaga

SEQ ID NO: 541798 - DNA, 514 bp, Homo sapiens
  misc_feature: HIJSMM301B0I1D.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtggggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaacccccactgtcactctgttccgtcctcctcg

SEQ ID NO: 541799 - DNA, 497 bp, Homo sapiens; identical to SEQ ID NO: 540789
  misc_feature: HIJSMM301CVA12.9.67.G01.1.454.light.4.raw

SEQ ID NO: 541800 - DNA, 498 bp, Homo sapiens
  misc_feature: HIJSMM301AQHMJ.2.42.D09.1.454.light.4.raw
acgctcgacacacgaccggtgctcgatttagacacatacgcagggaaaggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtccagtattcggcggagggaccaagctgaccgtcctaggtcagcccaagg

SEQ ID NO: 541801 - DNA, 459 bp, Homo sapiens
  misc_feature: HIJSMM301C27B6.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccacctcctcacgcgtatgt

SEQ ID NO: 541802 - DNA, 487 bp, Homo sapiens; identical to SEQ ID NO: 539157
  misc_feature: HIJSMM301AP0KM.26.37.D04.1.454.light.4.raw

SEQ ID NO: 541803 - DNA, 480 bp, Homo sapiens; identical to SEQ ID NO: 535291
  misc_feature: HIJSMM301AE771.22.59.F04.1.454.light.4.raw

SEQ ID NO: 541804 - DNA, 496 bp, Homo sapiens
  misc_feature: HIJSMM301AJJG8.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatccgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaagg

SEQ ID NO: 541805 - DNA, 486 bp, Homo sapiens; identical to SEQ ID NO: 535458
  misc_feature: HIJSMM301DLS6C.7.75.G09.1.454.light.4.raw

SEQ ID NO: 541806 - DNA, 440 bp, Homo sapiens
  misc_feature: HIJSMM301B6V7K.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtattctcg

SEQ ID NO: 541807 - DNA, 505 bp, Homo sapiens; identical to SEQ ID NO: 535503
  misc_feature: HIJSMM301A66M1.8.28.C06.1.454.light.4.raw

SEQ ID NO: 541808 - DNA, 508 bp, Homo sapiens
  misc_feature: HIJSMM301BGV7H.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatggggacagacttcactctcaccatcatcagcctggagcctgaggatgttgcagtttattactgtcaacatcgtaccgagtggcctccgggggccactttcggccctgggaccaaagtggatatcaacgaactgtggctgcaccatctgtcttcta

SEQ ID NO: 541809 - DNA, 444 bp, Homo sapiens; identical to SEQ ID NO: 535027
  misc_feature: HIJSMM301BPUR0.8.73.G07.1.454.light.4.raw

SEQ ID NO: 541810 - DNA, 343 bp, Homo sapiens
  misc_feature: HIJSMM301BUZB0.12.87.H10.1.454.light.4.raw
atacgacgtacacgaccggtgctcgatttagcagtactgcgttgggggaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccaccctcctctacgtcgtat

SEQ ID NO: 541811 - DNA, 500 bp, Homo sapiens
  misc_feature: HIJSMM301B1BUA.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaacccactgtca

SEQ ID NO: 541812 - DNA, 505 bp, Homo sapiens
  misc_feature: HIJSMM301CVAQB.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagatttttaccctcaccatcaggggtctacagcctgaagattttgcgacttactattgtcaacagagttaccttctcccccggacgttcggccagggaccgaaggtaggaagtacaagcgaactgtggctgcaccatctgtcttctatcttcccg

SEQ ID NO: 541813 - DNA, 493 bp, Homo sapiens
  misc_feature: HIJSMM301BBH8P.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggtcgggggcggaacgtaggtgagtataacgaaacgtacgtggtcgtcgcgacca

SEQ ID NO: 541814 - DNA, 505 bp, Homo sapiens
  misc_feature: HIJSMM301A72LN.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattgctgtcagcagcggggcaattggccgctcactttcggcgggggaccgaaggtggagttacaaacgaactgtggctgcaccatctgtcttcatcttccccg

SEQ ID NO: 541815 - DNA, 478 bp, Homo sapiens; identical to SEQ ID NO: 535129
  misc_feature: HIJSMM301EFXGO.11.11.A11.1.454.light.4.raw

SEQ ID NO: 541816 - DNA, 482 bp, Homo sapiens; identical to SEQ ID NO: 535796
  misc_feature: HIJSMM301AZRRZ.51.64.F09.1.454.light.4.raw

SEQ ID NO: 541817 - DNA, 447 bp, Homo sapiens
  misc_feature: HIJSMM301D2224.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 541818 - DNA, 493 bp, Homo sapiens
  misc_feature: HIJSMM301BJVLY.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggcaagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggaccaagctggagatcaaacgaactgtggctgcaccatctgtctt

SEQ ID NO: 541819 - DNA, 501 bp, Homo sapiens; identical to SEQ ID NO: 536867
  misc_feature: HIJSMM301BA5VE.5.86.H09.1.454.light.4.raw

SEQ ID NO: 541820 - DNA, 462 bp, Homo sapiens
  misc_feature: HIJSMM301AQWJ5.4.39.D06.1.454.light.4.raw
agcactgtagcacgaccggtgctcgatttagtgacatctcgcagttctttggggcttctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgccatctgactacagtgct

SEQ ID NO: 541821 - DNA, 508 bp, Homo sapiens
  misc_feature: HIJSMM301BINYO.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctc

SEQ ID NO: 541822 - DNA, 461 bp, Homo sapiens
  misc_feature: HIJSMM301CCBVN.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccagggctgaccgtcctaggtcagcccaaggctgccccctcggtcactctgttcccgccctcctcacgcgtatgt

SEQ ID NO: 541823 - DNA, 494 bp, Homo sapiens; identical to SEQ ID NO: 534994
  misc_feature: HIJSMM301AIW88.27.78.H01.1.454.light.4.raw

SEQ ID NO: 541824 - DNA, 496 bp, Homo sapiens
  misc_feature: HIJSMM301CEF1Y.13.67.G01.1.454.light.4.raw
tcacgtactacacgaccggtgctcgatttagagtatacatattgggtttggggagctacaacaggcaggcaggggcgagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctccatttcggcggagggaccaaggtggagatcaaacgaactgt

SEQ ID NO: 541825 - DNA, 493 bp, Homo sapiens; identical to SEQ ID NO: 535084
  misc_feature: HIJSMM301BK23P.47.64.F09.1.454.light.4.raw

SEQ ID NO: 541826 - DNA, 510 bp, Homo sapiens
  misc_feature: HIJSMM301EIPJ0.17.33.C11.1.454.light.4.raw
  modified_base (504)..(504): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccncctcct

SEQ ID NO: 541827 - DNA, 511 bp, Homo sapiens
  misc_feature: HIJSMM301BQJ5Q.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcggtggcagtgggtatgggacagacttcactctcaccatcatcagcctggagcctgaagatgttgcagtttattactgtcaacatcgtaccgagtggcctccgggggccactttcggccctcgggaccgaaggtggagatcaaacgaactgtggctgcaccatctgtcttcatt

SEQ ID NO: 541828 - DNA, 495 bp, Homo sapiens
  misc_feature: HIJSMM301A1P2Z.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 541829 - DNA, 509 bp, Homo sapiens
  misc_feature: HIJSMM301AN0XZ.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 541830 - DNA, 494 bp, Homo sapiens; identical to SEQ ID NO: 534994
  misc_feature: HIJSMM301COYVD.27.78.H01.1.454.light.4.raw

SEQ ID NO: 541831 - DNA, 506 bp, Homo sapiens; identical to SEQ ID NO: 541287
  misc_feature: HIJSMM301D0WVV.19.78.H01.1.454.light.4.raw

SEQ ID NO: 541832 - DNA, 484 bp, Homo sapiens
  misc_feature: HIJSMM301DOQ7N.27.78.H01.1.454.light.4.raw
  modified_base (454)..(454): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaatgatcaccttcgccaaggacacgaccnggagataaacgtaaactgtggcgtgcacca

SEQ ID NO: 541833 - DNA, 505 bp, Homo sapiens
  misc_feature: HIJSMM301BG6YS.48.41.D08.1.454.light.4.raw
agtatacatacacgaccggtgctcgatttagtcacgcgagaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatctgt

SEQ ID NO: 541834 - DNA, 484 bp, Homo sapiens; identical to SEQ ID NO: 535441
  misc_feature: HIJSMM301D2GL0.26.60.F05.1.454.light.4.raw

SEQ ID NO: 541835 - DNA, 494 bp, Homo sapiens
  misc_feature: HIJSMM301CD8MQ.43.62.F07.1.454.light.4.raw
tgtgagtagtcacgaccggtgctcgatttagtagtcgcataaagggaaaggggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgctgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaacgaaactgtggctgcaccatctgtcttcatt

SEQ ID NO: 541836 - DNA, 485 bp, Homo sapiens; identical to SEQ ID NO: 536263
  misc_feature: HIJSMM301E0KAM.47.78.H01.1.454.light.4.raw

SEQ ID NO: 541837 - DNA, 516 bp, Homo sapiens
  misc_feature: HIJSMM301B6RPH.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccaggctccagcctgaggacgaggctgattattattgtagttcatatacaaccagtgacacttgggtgttcggcggagggaccaggctgaccgtcctaggtcagcccaaggctgccccctcggtcactctgttccca

SEQ ID NO: 541838 - DNA, 485 bp, Homo sapiens
  misc_feature: HIJSMM301EFEY9.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccccg

SEQ ID NO: 541839 - DNA, 506 bp, Homo sapiens
  misc_feature: HIJSMM301AIF1E.43.42.D09.1.454.light.4.raw
tgtgagtagtcacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaacttcgtcggagggacgaacgtaggagagtcaacgaactagtggtcgtgtcgaccactactcgttcgttcta

SEQ ID NO: 541840 - DNA, 395 bp, Homo sapiens
  misc_feature: HIJSMM301EKM41.49.87.H10.1.454.light.4.raw
agtcgagagacacgaccggtgctcgatttagcagtactgcgttgggtttggggtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 541841 - DNA, 519 bp, Homo sapiens
  misc_feature: HIJSMM301BOYSV.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagccaaggctgcccctcggtcact

SEQ ID NO: 541842 - DNA, 493 bp, Homo sapiens; identical to SEQ ID NO: 535047
  misc_feature: HIJSMM301EYS70.16.53.E09.1.454.light.4.raw

SEQ ID NO: 541843 - DNA, 465 bp, Homo sapiens
  misc_feature: HIJSMM301EEVIE.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagattttcactctcaccatcagcagcctgcagcctgaagatgttgcaacttattactgtcaaaagatagcgctgccccgctcaagtttcggcggagggaccaaggtggagata

SEQ ID NO: 541844 - DNA, 485 bp, Homo sapiens; identical to SEQ ID NO: 534977
  misc_feature: HIJSMM301DYJEQ.15.28.C06.1.454.light.4.raw

SEQ ID NO: 541845 - DNA, 505 bp, Homo sapiens
  misc_feature: HIJSMM301DYLUO.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccaacctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaa

SEQ ID NO: 541846 - DNA, 492 bp, Homo sapiens
  misc_feature: HIJSMM301EZBTS.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccagggggagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcgtccctgggaccaaagtggatttcagacgaactgtggctgcaccatctgtcttcatt

SEQ ID NO: 541847 - DNA, 496 bp, Homo sapiens
  misc_feature: HIJSMM301AFO8T.14.55.E11.1.454.light.4.raw
  modified_base (451)..(451): a, c, t, g, unknown or other
  modified_base (486)..(486): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctctcttacgtcggacggacgacgaggngagtacagagaacgtagtggtcgcgtcgaccactntcgtcttcta

SEQ ID NO: 541848 - DNA, 485 bp, Homo sapiens; identical to SEQ ID NO: 538954
  misc_feature: HIJSMM301CAZXH.3.55.E11.1.454.light.4.raw

SEQ ID NO: 541849 - DNA, 497 bp, Homo sapiens; identical to SEQ ID NO: 536807
  misc_feature: HIJSMM301BCV1I.10.37.D04.1.454.light.4.raw

SEQ ID NO: 541850 - DNA, 487 bp, Homo sapiens
  misc_feature: HIJSMM301AVPKH.16.78.H01.1.454.light.4.raw
  modified_base (458)..(458): a, c, t, g, unknown or other
  modified_base (460)..(460): a, c, t, g, unknown or other
  modified_base (484)..(484): a, c, t, g, unknown or other
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactgcctccacggtacacttgtcacggacgagacngngatacaacgaactagtagcgtgcncca

SEQ ID NO: 541851 - DNA, 507 bp, Homo sapiens; identical to SEQ ID NO: 539752
  misc_feature: HIJSMM301CVKW5.11.1.A01.1.454.light.4.raw

SEQ ID NO: 541852 - DNA, 495 bp, Homo sapiens; identical to SEQ ID NO: 535143
  misc_feature: HIJSMM301ASUMY.51.29.C07.1.454.light.4.raw

SEQ ID NO: 541853 - DNA, 489 bp, Homo sapiens; identical to SEQ ID NO: 535091
  misc_feature: HIJSMM301AH7RO.47.36.D03.1.454.light.4.raw

SEQ ID NO: 541854 - DNA, 491 bp, Homo sapiens
  misc_feature: HIJSMM301ES41X.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccaggctcactttcggcggagggaccaaggtggaggatcaaacgaa

SEQ ID NO: 541855 - DNA, 497 bp, Homo sapiens; identical to SEQ ID NO: 538061
  misc_feature: HIJSMM301A0C01.16.46.E02.1.454.light.4.raw

SEQ ID NO: 541856 - DNA, 478 bp, Homo sapiens
  misc_feature: HIJSMM301D46Q2.49.63.F08.1.454.light.4.raw
agtcgagagacacgaccggtgctcgatttagcgatcgtataagggggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaagctggagatcacacgaactgtggctgcaccatctgtcttcatcttcccgcc

SEQ ID NO: 541857 - DNA, 496 bp, Homo sapiens
  misc_feature: HIJSMM301E2JIY.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggaggatcaaacgaactgtggctgcaccatctgtctt

SEQ ID NO: 541858 - DNA, 477 bp, Homo sapiens; identical to SEQ ID NO: 535122
  misc_feature: HIJSMM301CTU42.26.72.G06.1.454.light.4.raw

SEQ ID NO: 541859 - DNA, 493 bp, Homo sapiens
  misc_feature: HIJSMM301A9KFH.16.73.G07.1.454.light.4.raw
tgtactactccacgaccggtgctcgatttagctctacgctcaggggcaggcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccta

SEQ ID NO: 541860 - DNA, 491 bp, Homo sapiens; identical to SEQ ID NO: 535294
  misc_feature: HIJSMM301BEC56.16.68.G02.1.454.light.4.raw

SEQ ID NO: 541861 - DNA, 487 bp, Homo sapiens
  misc_feature: HIJSMM301A2JAM.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctcccatcactttcggccaaggacacgaccgcagattggacgaactgtggctgcacc

SEQ ID NO: 541862 - DNA, 493 bp, Homo sapiens
  misc_feature: HIJSMM301ASXT0.27.78.H01.1.454.light.4.raw
  modified_base (476)..(476): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaacngtggctgcaccatctgt

SEQ ID NO: 541863 - DNA, 383 bp, Homo sapiens
  misc_feature: HIJSMM301D7Y6P.41.78.H01.1.454.light.4.raw
tctatactatcacgaccggtgctcgatttagtgtgagtagtttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccgaaggtggagatcaacgaaactgtggctgcaccatctgtcttcatcttcccgccatctgaatagtataga

SEQ ID NO: 541864 - DNA, 494 bp, Homo sapiens; identical to SEQ ID NO: 534992
  misc_feature: HIJSMM301ESOS2.9.1.A01.1.454.light.4.raw

SEQ ID NO: 541865 - DNA, 514 bp, Homo sapiens
  misc_feature: HIJSMM301A52HF.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgtaga

SEQ ID NO: 541866 - DNA, 497 bp, Homo sapiens; identical to SEQ ID NO: 535664
  misc_feature: HIJSMM301CW7X1.22.14.B03.1.454.light.4.raw

SEQ ID NO: 541867 - DNA, 510 bp, Homo sapiens
  misc_feature: HIJSMM301EU1YV.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagactgatattaacagcgaaaagagattttgttaaggggaaagtaatgaagttaa

SEQ ID NO: 541868 - DNA, 488 bp, Homo sapiens
  misc_feature: HIJSMM301EHZW9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcggagatcagacgaactgtggctgcaccatctgtcttcta

SEQ ID NO: 541869 - DNA, 484 bp, Homo sapiens; identical to SEQ ID NO: 535400
  misc_feature: HIJSMM301BXHLE.46.26.C04.1.454.light.4.raw

SEQ ID NO: 541870 - DNA, 505 bp, Homo sapiens; identical to SEQ ID NO: 535503
  misc_feature: HIJSMM301BMCPM.8.28.C06.1.454.light.4.raw

SEQ ID NO: 541871 - DNA, 488 bp, Homo sapiens; identical to SEQ ID NO: 535861
  misc_feature: HIJSMM301BG10V.14.55.E11.1.454.light.4.raw

SEQ ID NO: 541872 - DNA, 500 bp, Homo sapiens
  misc_feature: HIJSMM301AY4Y2.48.82.H05.1.454.light.4.raw
agtatacatacacgaccggtgctcgatttagtcgagctctctcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcacctcatatacaagcagcagcactctcgtggtattcggcggagggaccaagctgaccgtcctaggtcagcccaaggctgccccctc

SEQ ID NO: 541873 - DNA, 374 bp, Homo sapiens
  misc_feature: HIJSMM301EEBAF.19.60.F05.1.454.light.4.raw
tactctcgtgcacgaccggtgctcgatttagtacgtcatcaggggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagta

SEQ ID NO: 541874 - DNA, 486 bp, Homo sapiens; identical to SEQ ID NO: 535385
  misc_feature: HIJSMM301A16R0.19.71.G05.1.454.light.4.raw

SEQ ID NO: 541875 - DNA, 492 bp, Homo sapiens; identical to SEQ ID NO: 538644
  misc_feature: HIJSMM301DF89N.26.78.H01.1.454.light.4.raw

SEQ ID NO: 541876 - DNA, 492 bp, Homo sapiens
  misc_feature: HIJSMM301CWQ3Z.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgccca

SEQ ID NO: 541877 - DNA, 488 bp, Homo sapiens
  misc_feature: HIJSMM301DGR2B.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtaggataatcagacgaa

SEQ ID NO: 541878 - DNA, 485 bp, Homo sapiens; identical to SEQ ID NO: 538787
  misc_feature: HIJSMM301ES0CE.49.57.F02.1.454.light.4.raw

SEQ ID NO: 541879 - DNA, 494 bp, Homo sapiens; identical to SEQ ID NO: 535276
  misc_feature: HIJSMM301ALCQE.16.6.A06.1.454.light.4.raw

SEQ ID NO: 541880 - DNA, 496 bp, Homo sapiens
  misc_feature: HIJSMM301CA4XM.48.47.E03.1.454.light.4.raw
agtatacatacacgaccggtgctcgatttagactcgcgcacagagagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 541881 - DNA, 496 bp, Homo sapiens; identical to SEQ ID NO: 535109
  misc_feature: HIJSMM301DFEUB.16.78.H01.1.454.light.4.raw

SEQ ID NO: 541882 - DNA, 448 bp, Homo sapiens; identical to SEQ ID NO: 534998
  misc_feature: HIJSMM301CKL96.18.9.A09.1.454.light.4.raw

SEQ ID NO: 541883 - DNA, 484 bp, Homo sapiens; identical to SEQ ID NO: 535240
  misc_feature: HIJSMM301BPPLH.47.60.F05.1.454.light.4.raw

SEQ ID NO: 541884 - DNA, 494 bp, Homo sapiens
  misc_feature: HIJSMM301A8NLI.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggttcgagggaccgaagttgaacatcaatcgaactgtggctgcaccatctgtctt

SEQ ID NO: 541885 - DNA, 485 bp, Homo sapiens
  misc_feature: HIJSMM301DSMRN.48.54.E10.1.454.light.4.raw
agtatacatacacgaccggtgctcgatttagatcgtagcagaacacacaaagggggaggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggaccagctccaacatcggcgtaggttatgatgtacactggtaccagcaacttccaggaacagtccccagactcctcatctatgataacaacaatcggccctcaggggtccctgaccggttctctggctccaagtctggcacctcagcctccctggccatcactgggctccagactgaggatgaggctgattattactgccagtcctatgacagcaacctgagcggttgggtgttcggcggagggacca

SEQ ID NO: 541886 - DNA, 497 bp, Homo sapiens; identical to SEQ ID NO: 535664
  misc_feature: HIJSMM301BULFB.22.14.B03.1.454.light.4.raw

SEQ ID NO: 541887 - DNA, 494 bp, Homo sapiens; identical to SEQ ID NO: 536974
  misc_feature: HIJSMM301B0NAQ.16.86.H09.1.454.light.4.raw

SEQ ID NO: 541888 - DNA, 499 bp, Homo sapiens
  misc_feature: HIJSMM301BP6C7.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccaaggtggagatcaacgaactgtggctgcaccatctgtcttcatcttccccg

SEQ ID NO: 541889 - DNA, 487 bp, Homo sapiens
  misc_feature: HIJSMM301BAXRK.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcgttcggccaggggaccaaggtggaagtcaagcgaactgtggctgcaccatctgt

SEQ ID NO: 541890 - DNA, 489 bp, Homo sapiens; identical to SEQ ID NO: 535386
  misc_feature: HIJSMM301B9ARH.12.51.E07.1.454.light.4.raw

SEQ ID NO: 541891 - DNA, 515 bp, Homo sapiens
  misc_feature: HIJSMM301EHZ2U.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcatccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccactcgtcactc

SEQ ID NO: 541892 - DNA, 454 bp, Homo sapiens
  misc_feature: HIJSMM301EE8AN.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaggtcagcccaaggccaaccccactgtcactctgttcccaccctcctccacgagagta

SEQ ID NO: 541893 - DNA, 511 bp, Homo sapiens
  misc_feature: HIJSMM301DM0X9.48.27.C05.1.454.light.4.raw
agtatacatacacgaccggtgctcgatttagacgcgatcgaagggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgcccctcggtcactctcgttcccg

SEQ ID NO: 541894 - DNA, 447 bp, Homo sapiens; identical to SEQ ID NO: 535020
  misc_feature: HIJSMM301AEPJI.18.9.A09.1.454.light.4.raw

SEQ ID NO: 541895 - DNA, 490 bp, Homo sapiens; identical to SEQ ID NO: 535936
  misc_feature: HIJSMM301ECWCF.16.68.G02.1.454.light.4.raw

SEQ ID NO: 541896 - DNA, 508 bp, Homo sapiens
  misc_feature: HIJSMM301AQI31.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcactc

SEQ ID NO: 541897 - DNA, 503 bp, Homo sapiens
  misc_feature: HIJSMM301DJWW2.18.37.D04.1.454.light.4.raw
  modified_base (495)..(495): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaatcagcagggtggaggctgaggatgttggggtttattactgcatgcaaactacacacggccgctcacttcggcggagggaccaaggtggagatcaaacgaactgtggctgcnccatctgt

SEQ ID NO: 541898 - DNA, 515 bp, Homo sapiens
  misc_feature: HIJSMM301AFHES.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccaccctcctcgagtagtaca

SEQ ID NO: 541899 - DNA, 490 bp, Homo sapiens
  misc_feature: HIJSMM301EGH3B.10.17.B06.1.454.light.4.raw
  modified_base (467)..(467): a, c, t, g, unknown or other
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctcgtacacttttggccggggccaagctggaaatcaagcgaactntggctgcaccatctgtcttcatt

SEQ ID NO: 541900 - DNA, 496 bp, Homo sapiens; identical to SEQ ID NO: 535423
  misc_feature: HIJSMM301ALL3L.3.33.C11.1.454.light.4.raw

SEQ ID NO: 541901 - DNA, 444 bp, Homo sapiens; identical to SEQ ID NO: 536096
  misc_feature: HIJSMM301DBSDW.7.18.B07.1.454.light.4.raw

SEQ ID NO: 541902 - DNA, 383 bp, Homo sapiens; identical to SEQ ID NO: 447524
  misc_feature: HIJSMM301DMRJS.41.26.C04.1.454.light.4.raw

SEQ ID NO: 541903 - DNA, 327 bp, Homo sapiens
  misc_feature: HIJSMM301BF339.49.55.E11.1.454.light.4.raw
agtcgagagacacgaccggtgctcgatttagcactcgcacgttgggtttggggcagcttcagctgtggtagagaagacaggattcaggacaatctccagcatggccggcttccctctcctcctcaccctcctcactcactgtgcagggtcctgggcccggtctgtgctgactcagccaccctcaacgtctgggacccccgggcaaagggtcaccatgtcttgttctggaagctgctccaatatcgtcactccttatgtgtactgacaccaggtcagcccaaggctgccccctcggtcactctgttcccaccctcctctctctcgact

SEQ ID NO: 541904 - DNA, 472 bp, Homo sapiens; identical to SEQ ID NO: 540871
  misc_feature: HIJSMM301CL9GY.13.48.E04.1.454.light.4.raw

SEQ ID NO: 541905 - DNA, 519 bp, Homo sapiens
  misc_feature: HIJSMM301BGELM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacgcttgggtgttcggcggagggaccaggctgaccgtcctaggtcagccaaggctgccccctcggtcactctgttcccacct

SEQ ID NO: 541906 - DNA, 494 bp, Homo sapiens; identical to SEQ ID NO: 535629
  misc_feature: HIJSMM301BWX81.4.27.C05.1.454.light.4.raw

SEQ ID NO: 541907 - DNA, 490 bp, Homo sapiens
  misc_feature: HIJSMM301CO2HR.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgactgattcagtggcagcgggtctgggacagatttcactctcaccatcagcagcctgcaggctgaagatgtggcagtttattactgtcagcaatattatagtactcctccgaggctcacttttcggcggagggaccaaggtggagatcaaacgaactgt

SEQ ID NO: 541908 - DNA, 508 bp, Homo sapiens
  misc_feature: HIJSMM301DUQXC.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactc

SEQ ID NO: 541909 - DNA, 494 bp, Homo sapiens; identical to SEQ ID NO: 535680
  misc_feature: HIJSMM301E0KX6.16.78.H01.1.454.light.4.raw

SEQ ID NO: 541910 - DNA, 502 bp, Homo sapiens
  misc_feature: HIJSMM301CPLU1.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggtcggagggaccaaggtggagatcaaacgaactgtggctgcaccatctgtcttcatcttcccgccat

SEQ ID NO: 541911 - DNA, 519 bp, Homo sapiens
  misc_feature: HIJSMM301DHT2O.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 541912 - DNA, 444 bp, Homo sapiens; identical to SEQ ID NO: 535192
  misc_feature: HIJSMM301C2X84.5.9.A09.1.454.light.4.raw

SEQ ID NO: 541913 - DNA, 500 bp, Homo sapiens
  misc_feature: HIJSMM301A0R95.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtcccgtgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggccaaccccactgtcactctgttccccaccctcctcgagtagtaca

SEQ ID NO: 541914 - DNA, 496 bp, Homo sapiens
  misc_feature: HIJSMM301BG2KZ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccagggtggagatcaaacgaactgtggctgcaccatctgtcttcattcc

SEQ ID NO: 541915 - DNA, 478 bp, Homo sapiens
  misc_feature: HIJSMM301BLPQZ.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgactgtgg

SEQ ID NO: 541916 - DNA, 508 bp, Homo sapiens
  misc_feature: HIJSMM301CHKTR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaatagagacgaactacgtggctgcaccactctgtcttctactcttcccgt

SEQ ID NO: 541917 - DNA, 484 bp, Homo sapiens; identical to SEQ ID NO: 537878
  misc_feature: HIJSMM301AWFMQ.17.34.D01.1.454.light.4.raw

SEQ ID NO: 541918 - DNA, 496 bp, Homo sapiens
  misc_feature: HIJSMM301D36JY.49.25.C03.1.454.light.4.raw
agtcgagagacacgaccggtgctcgatttagtagtgtagatttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 541919 - DNA, 508 bp, Homo sapiens
  misc_feature: HIJSMM301DE71D.19.72.G06.1.454.light.4.raw
tactctcgtgcacgaccggtgctcgatttagctacgactgcaagggaaagggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacatgggtgtgcggcggagggaccaaggtgaccgtcctgggtcagcccaaggctgccccctcggtcactc

SEQ ID NO: 541920 - DNA, 471 bp, Homo sapiens
  misc_feature: HIJSMM301AR68R.13.76.G10.1.454.light.4.raw
tcacgtactacacgaccggtgctcgatttagtcactcatacagggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 541921 - DNA, 447 bp, Homo sapiens
  misc_feature: HIJSMM301BL2OZ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccactgtcactctgttcccaccctcctccatactcgta

SEQ ID NO: 541922 - DNA, 493 bp, Homo sapiens
  misc_feature: HIJSMM301A17RT.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttattctgccaacaatacaccactttgtggacgttcggccgggggaccgaacggtggagatcaagcgaactgtggctgcaccatctgtcttcatcttcccgt

SEQ ID NO: 541923 - DNA, 507 bp, Homo sapiens
  misc_feature: HIJSMM301AL9NJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaaactagtggctgcaccatctgtcttcatcttccccg

SEQ ID NO: 541924 - DNA, 500 bp, Homo sapiens
  misc_feature: HIJSMM301AHJWP.18.59.F04.1.454.light.4.raw
tacgagtatgcacgaccggtgctcgatttagtacacacacttagggattgggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctcctatgtcttcggaacctgggaccaaggtcaccgtcctaggtcagcccaaggccaa

SEQ ID NO: 541925 - DNA, 443 bp, Homo sapiens
  misc_feature: HIJSMM301AJQPI.10.76.G10.1.454.light.4.raw
catagtagtgcacgaccggtgctcgatttagtcactcatacagggccctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctccactactatg

SEQ ID NO: 541926 - DNA, 495 bp, Homo sapiens
  misc_feature: HIJSMM301C6XT1.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccaggggaccaagctggaggatcaaacgaactgtggctgcaccatctgtctt

SEQ ID NO: 541927 - DNA, 464 bp, Homo sapiens; identical to SEQ ID NO: 537214
  misc_feature: HIJSMM301CQAC0.18.59.F04.1.454.light.4.raw

SEQ ID NO: 541928 - DNA, 478 bp, Homo sapiens
  misc_feature: HIJSMM301C0DB7.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcacc

SEQ ID NO: 541929 - DNA, 496 bp, Homo sapiens
  misc_feature: HIJSMM301AFQWA.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaaggaccgaaggtggaagtcaaacgaactagtggcgtgcaccatctgtcttcatcttcccgt

SEQ ID NO: 541930 - DNA, 429 bp, Homo sapiens
  misc_feature: HIJSMM301DHDDH.49.34.D01.1.454.light.4.raw
agtcgagagacacgaccggtgctcgatttagatcgtctgtgttgggtttgggtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaaacgaactgtggctgcaccatctgtcttcatcttcccgccatctgatctctcgact

SEQ ID NO: 541931 - DNA, 493 bp, Homo sapiens; identical to SEQ ID NO: 535084
  misc_feature: HIJSMM301ANPYK.47.64.F09.1.454.light.4.raw

SEQ ID NO: 541932 - DNA, 484 bp, Homo sapiens
  misc_feature: HIJSMM301A4BAJ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctactaga

SEQ ID NO: 541933 - DNA, 489 bp, Homo sapiens
  misc_feature: HIJSMM301AI6YB.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaactgt

SEQ ID NO: 541934 - DNA, 510 bp, Homo sapiens
  misc_feature: HIJSMM301CU3A0.51.38.D05.1.454.light.4.raw
cgatcgtatacacgaccggtgctcgatttagtatctgatagttgggtttgggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgatttattactgcagctcatatacaatcaataacaattgggtgttcggcggagggaccaaactgaccgtcctaggtcagcccaaggctgccccctcggtcactc

SEQ ID NO: 541935 - DNA, 488 bp, Homo sapiens; identical to SEQ ID NO: 535861
  misc_feature: HIJSMM301BTJY8.14.55.E11.1.454.light.4.raw

SEQ ID NO: 541936 - DNA, 492 bp, Homo sapiens
  misc_feature: HIJSMM301BLKJW.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggttgttcctccatgcaaggtacacactggccttttggccaggggaccaacctggagatcaaatgaactgtggctgcaccatctgtctt

SEQ ID NO: 541937 - DNA, 447 bp, Homo sapiens; identical to SEQ ID NO: 535201
  misc_feature: HIJSMM301BLXKX.18.9.A09.1.454.light.4.raw

SEQ ID NO: 541938 - DNA, 489 bp, Homo sapiens
  misc_feature: HIJSMM301DQ9PS.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccatgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggacgaacggacggagatcagacgaactagtggctgcaccactctgtctt

SEQ ID NO: 541939 - DNA, 447 bp, Homo sapiens; identical to SEQ ID NO: 535201
  misc_feature: HIJSMM301A3L7B.18.9.A09.1.454.light.4.raw

SEQ ID NO: 541940 - DNA, 420 bp, Homo sapiens
  misc_feature: HIJSMM301EPRQQ.9.34.D01.1.454.light.4.raw
tgatacgtctcacgaccggtgctcgatttagatcgtctgtgttgggtttgggggctgttcctggaagttgttggtaccagtgtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaccccactgtcactctgttcccgccctcctcagacgtatca

SEQ ID NO: 541941 - DNA, 494 bp, Homo sapiens
  misc_feature: HIJSMM301CR4YI.47.64.F09.1.454.light.4.raw
agctcacgtacacgaccggtgctcgatttagcgcgtatacacgggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcatt

SEQ ID NO: 541942 - DNA, 498 bp, Homo sapiens; identical to SEQ ID NO: 535842
  misc_feature: HIJSMM301DTXUG.22.27.C05.1.454.light.4.raw

SEQ ID NO: 541943 - DNA, 460 bp, Homo sapiens; identical to SEQ ID NO: 536053
  misc_feature: HIJSMM301EEF7X.22.28.C06.1.454.light.4.raw

SEQ ID NO: 541944 - DNA, 514 bp, Homo sapiens; identical to SEQ ID NO: 541634
  misc_feature: HIJSMM301D83EM.10.80.H03.1.454.light.4.raw

SEQ ID NO: 541945 - DNA, 492 bp, Homo sapiens
  misc_feature: HIJSMM301BMG8P.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 541946 - DNA, 445 bp, Homo sapiens; identical to SEQ ID NO: 537719
  misc_feature: HIJSMM301A7LCP.47.85.H08.1.454.light.4.raw

SEQ ID NO: 541947 - DNA, 495 bp, Homo sapiens; identical to SEQ ID NO: 539326
  misc_feature: HIJSMM301CTVGO.52.86.H09.1.454.light.4.raw

SEQ ID NO: 541948 - DNA, 470 bp, Homo sapiens; identical to SEQ ID NO: 536130
  misc_feature: HIJSMM301DKETA.7.81.H04.1.454.light.4.raw

SEQ ID NO: 541949 - DNA, 492 bp, Homo sapiens; identical to SEQ ID NO: 534967
  misc_feature: HIJSMM301CL25Q.47.64.F09.1.454.light.4.raw

SEQ ID NO: 541950 - DNA, 484 bp, Homo sapiens; identical to SEQ ID NO: 535400
  misc_feature: HIJSMM301AJM0E.46.26.C04.1.454.light.4.raw

SEQ ID NO: 541951 - DNA, 486 bp, Homo sapiens; identical to SEQ ID NO: 537238
  misc_feature: HIJSMM301B9UTU.19.71.G05.1.454.light.4.raw

SEQ ID NO: 541952 - DNA, 495 bp, Homo sapiens; identical to SEQ ID NO: 535821
  misc_feature: HIJSMM301A17QK.3.31.C09.1.454.light.4.raw

SEQ ID NO: 541953 - DNA, 508 bp, Homo sapiens; identical to SEQ ID NO: 537871
  misc_feature: HIJSMM301BAYQP.8.33.C11.1.454.light.4.raw

SEQ ID NO: 541954 - DNA, 505 bp, Homo sapiens
  misc_feature: HIJSMM301EIPZ4.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 541955 - DNA, 517 bp, Homo sapiens
  misc_feature: HIJSMM301CU10T.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacg

SEQ ID NO: 541956 - DNA, 503 bp, Homo sapiens
  misc_feature: HIJSMM301AYZOI.48.74.G08.1.454.light.4.raw
agtatacatacacgaccggtgctcgatttagtagctctatcaggggagcttcagctgtggtagagaagacaggattcaggacaatctccagcatggccggcttccctctcctcctcaccctcctcactcactgtacagggtcctgggcccagtctgtgctgactcagccaccctcagcgtctgggacccccggacagagggtcaccatctcttgttctggaagcagttccaacatcggaagtaattctgtattctggtaccagcagctcccaggatcggcccccaaacttgctcatctatatgaataatcaacggccctttggggtccctgaccgattctctggctccaagtctgacacctcagcctccctggccatcagtgggctccggtccgaggatgaggctgattattactgtgcagcatgggatgacagtcatgtgcttttcggcggagggaccaaggtgaccgtcctaggtcagcccaaggctgccccctcggtcta

SEQ ID NO: 541957 - DNA, 497 bp, Homo sapiens
  misc_feature: HIJSMM301D54AI.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaggaaccaaggtggaaatcaaacgaactgtggctgcacc

SEQ ID NO: 541958 - DNA, 463 bp, Homo sapiens; identical to SEQ ID NO: 535062
  misc_feature: HIJSMM301CKP6Q.11.73.G07.1.454.light.4.raw

SEQ ID NO: 541959 - DNA, 447 bp, Homo sapiens; identical to SEQ ID NO: 535020
  misc_feature: HIJSMM301E0RBS.18.9.A09.1.454.light.4.raw

SEQ ID NO: 541960 - DNA, 506 bp, Homo sapiens
  misc_feature: HIJSMM301BWCN8.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttctaggggtttccgtaatcgcttcttctggctccaagtctggcgacacggcctccctgaccatctctgggctccaggctgaagacgaggctgattattactgcagctcatatacaggcagcagcactcaggttttcggcggagggaccaagctgaccggtcctaggtcagcccgaaggctcgccccctccggt

SEQ ID NO: 541961 - DNA, 495 bp, Homo sapiens
  misc_feature: HIJSMM301CTP0W.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtctt

SEQ ID NO: 541962 - DNA, 447 bp, Homo sapiens; identical to SEQ ID NO: 535020
  misc_feature: HIJSMM301DN7C5.18.9.A09.1.454.light.4.raw

SEQ ID NO: 541963 - DNA, 486 bp, Homo sapiens; identical to SEQ ID NO: 535523
  misc_feature: HIJSMM301D7T4X.22.73.G07.1.454.light.4.raw

SEQ ID NO: 541964 - DNA, 455 bp, Homo sapiens; identical to SEQ ID NO: 535447
  misc_feature: HIJSMM301BYJM0.19.71.G05.1.454.light.4.raw

SEQ ID NO: 541965 - DNA, 444 bp, Homo sapiens; identical to SEQ ID NO: 535594
  misc_feature: HIJSMM301AUR2M.9.9.A09.1.454.light.4.raw

SEQ ID NO: 541966 - DNA, 488 bp, Homo sapiens; identical to SEQ ID NO: 536554
  misc_feature: HIJSMM301AHQF2.26.37.D04.1.454.light.4.raw

SEQ ID NO: 541967 - DNA, 510 bp, Homo sapiens
  misc_feature: HIJSMM301AIUDO.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactcgtcact

SEQ ID NO: 541968 - DNA, 492 bp, Homo sapiens
  misc_feature: HIJSMM301DRYGS.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgcccctcggtcactctgttcccaccctcctcagacgtatca

SEQ ID NO: 541969 - DNA, 488 bp, Homo sapiens
  misc_feature: HIJSMM301B2N3N.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttccccctcactttcggcggagggaccgaaggtggagatcaagcgaactgtggctgcaccat

SEQ ID NO: 541970 - DNA, 493 bp, Homo sapiens
  misc_feature: HIJSMM301CC0RV.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccagggaccgaacggtggaagtacaacgaactagtggctgcaccatctgtctt

SEQ ID NO: 541971 - DNA, 502 bp, Homo sapiens
  misc_feature: HIJSMM301C763K.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 541972 - DNA, 383 bp, Homo sapiens; identical to SEQ ID NO: 447524
  misc_feature: HIJSMM301C7YGJ.41.26.C04.1.454.light.4.raw

SEQ ID NO: 541973 - DNA, 497 bp, Homo sapiens
  misc_feature: HIJSMM301DDFN0.22.65.F10.1.454.light.4.raw
  modified_base (474)..(474): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacgatcccaggatgacccagtcgtccagtcctacccgtgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactntgggctgcaccatctgtcttcat

SEQ ID NO: 541974 - DNA, 490 bp, Homo sapiens
  misc_feature: HIJSMM301B26IJ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcatt

SEQ ID NO: 541975 - DNA, 508 bp, Homo sapiens
  misc_feature: HIJSMM301AWMOG.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccgaaggtggaaatacaaacgaactagtggctgcaccatctgtcttcatcttcccgccact

SEQ ID NO: 541976 - DNA, 507 bp, Homo sapiens
  misc_feature: HIJSMM301BILC4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtggaaagtcaaacgaacagtggcgtgcgaccatctgtcttctatcttccccg

SEQ ID NO: 541977 - DNA, 494 bp, Homo sapiens
  misc_feature: HIJSMM301BZABD.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttagttactgtcagcagcgtgagttctggcctccgctcactttcggcggagggaccagggtggaggatcaaacgaactgtggctgcaccatctgtcttcat

SEQ ID NO: 541978 - DNA, 485 bp, Homo sapiens
  misc_feature: HIJSMM301B2Z7I.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccgacagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 541979 - DNA, 492 bp, Homo sapiens; identical to SEQ ID NO: 535126
  misc_feature: HIJSMM301CST96.18.11.A11.1.454.light.4.raw

SEQ ID NO: 541980 - DNA, 447 bp, Homo sapiens; identical to SEQ ID NO: 535201
  misc_feature: HIJSMM301CQ11E.18.9.A09.1.454.light.4.raw

SEQ ID NO: 541981 - DNA, 506 bp, Homo sapiens; identical to SEQ ID NO: 536355
  misc_feature: HIJSMM301EQF9N.47.85.H08.1.454.light.4.raw

SEQ ID NO: 541982 - DNA, 486 bp, Homo sapiens
  misc_feature: HIJSMM301AL5GO.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgagacagaattcactctcacaatcagcagcctgcagcctgaagattttgcaacttattactgtcaacagcttaatagttacccgctcagtttcggcggagggaccaaggtggagatcaaacgaactgtggctgcaccatctgtctt

SEQ ID NO: 541983 - DNA, 483 bp, Homo sapiens
  misc_feature: HIJSMM301EGRXY.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgacgtcctaggtcagacccg

SEQ ID NO: 541984 - DNA, 485 bp, Homo sapiens
  misc_feature: HIJSMM301CQN4E.40.69.G03.1.454.light.4.raw
tctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagcctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcacc

SEQ ID NO: 541985 - DNA, 519 bp, Homo sapiens
  misc_feature: HIJSMM301BOYMQ.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccta

SEQ ID NO: 541986 - DNA, 495 bp, Homo sapiens; identical to SEQ ID NO: 535486
  misc_feature: HIJSMM301BW2S9.26.72.G06.1.454.light.4.raw

SEQ ID NO: 541987 - DNA, 488 bp, Homo sapiens
  misc_feature: HIJSMM301B8BAW.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccccg

SEQ ID NO: 541988 - DNA, 508 bp, Homo sapiens
  misc_feature: HIJSMM301D79BN.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaaggctgccccctc

SEQ ID NO: 541989 - DNA, 519 bp, Homo sapiens
  misc_feature: HIJSMM301ER7WF.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgccaggtgtggaatggtgattatgattatgtcttcggaactgggaccaaggtcaccgtcctaggtcagcccaaggccaacccactgtcactctgttcccaccctcctccgtcgt

SEQ ID NO: 541990 - DNA, 483 bp, Homo sapiens
  misc_feature: HIJSMM301DCG7R.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcgagggaccaaggtggagatcaaacgaa

SEQ ID NO: 541991 - DNA, 444 bp, Homo sapiens; identical to SEQ ID NO: 535192
  misc_feature: HIJSMM301EBZNN.5.9.A09.1.454.light.4.raw

SEQ ID NO: 541992 - DNA, 489 bp, Homo sapiens; identical to SEQ ID NO: 536013
  misc_feature: HIJSMM301A203W.26.23.C01.1.454.light.4.raw

SEQ ID NO: 541993 - DNA, 503 bp, Homo sapiens; identical to SEQ ID NO: 535044
  misc_feature: HIJSMM301BGUUJ.19.78.H01.1.454.light.4.raw

SEQ ID NO: 541994 - DNA, 496 bp, Homo sapiens; identical to SEQ ID NO: 537925
  misc_feature: HIJSMM301CC3W1.22.14.B03.1.454.light.4.raw

SEQ ID NO: 541995 - DNA, 485 bp, Homo sapiens; identical to SEQ ID NO: 535985
  misc_feature: HIJSMM301CQZY5.15.1.A01.1.454.light.4.raw

SEQ ID NO: 541996 - DNA, 518 bp, Homo sapiens; identical to SEQ ID NO: 539372
  misc_feature: HIJSMM301DFX0V.7.86.H09.1.454.light.4.raw

SEQ ID NO: 541997 - DNA, 500 bp, Homo sapiens
  misc_feature: HIJSMM301A3N6A.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcattttcccgccatctgacata

SEQ ID NO: 541998 - DNA, 484 bp, Homo sapiens
  misc_feature: HIJSMM301BUQH8.48.68.G02.1.454.light.4.raw
agtatacatacacgaccggtgctcgatttagtcgatagtgaagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcagcccc

SEQ ID NO: 541999 - DNA, 454 bp, Homo sapiens; identical to SEQ ID NO: 535005
  misc_feature: HIJSMM301BJOW8.19.86.H09.1.454.light.4.raw

SEQ ID NO: 542000 - DNA, 447 bp, Homo sapiens; identical to SEQ ID NO: 535201
  misc_feature: HIJSMM301DNHP3.18.9.A09.1.454.light.4.raw

SEQ ID NO: 542001 - DNA, 489 bp, Homo sapiens; identical to SEQ ID NO: 535386
  misc_feature: HIJSMM301ER2BK.12.51.E07.1.454.light.4.raw

SEQ ID NO: 542002 - DNA, 507 bp, Homo sapiens
  misc_feature: HIJSMM301A7NLS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaatacaaacgaactagtggctgcaccatctgtcttcatcttccccg

SEQ ID NO: 542003 - DNA, 472 bp, Homo sapiens
  misc_feature: HIJSMM301B0168.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagcctggccgccttcggcggagggaccaaggtggagatcgaacgaactgtgg

SEQ ID NO: 542004 - DNA, 470 bp, Homo sapiens
  misc_feature: HIJSMM301DJ2NA.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagatttgcaacttactttgtcaacaggctcagagtttcccgctcactttcggcggagggaccaaggtggagatcaaacgaa

SEQ ID NO: 542005 - DNA, 483 bp, Homo sapiens
  misc_feature: HIJSMM301BNSTZ.49.83.H06.1.454.light.4.raw
agtcgagagacacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcggccctcggaccaggctagatatcggacgaactgtggctgcaccat

SEQ ID NO: 542006 - DNA, 487 bp, Homo sapiens
  misc_feature: HIJSMM301D6R7Y.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccagggtggaaagtacaaacgaactagtggctgcaccatctgtctt

SEQ ID NO: 542007 - DNA, 511 bp, Homo sapiens
  misc_feature: HIJSMM301EVSFH.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 542008 - DNA, 473 bp, Homo sapiens
  misc_feature: HIJSMM301D907W.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaagtcaaacgaactgtgg

SEQ ID NO: 542009 - DNA, 483 bp, Homo sapiens
  misc_feature: HIJSMM301DU1T5.48.22.B11.1.454.light.4.raw
agtatacatacacgaccggtgctcgatttagacgacagctcaggggcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtctt

SEQ ID NO: 542010 - DNA, 505 bp, Homo sapiens
  misc_feature: HIJSMM301AMHM7.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaagaccaaccccactgtcactcttcg

SEQ ID NO: 542011 - DNA, 496 bp, Homo sapiens
  misc_feature: HIJSMM301EX9OF.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccccg

SEQ ID NO: 542012 - DNA, 484 bp, Homo sapiens; identical to SEQ ID NO: 537878
  misc_feature: HIJSMM301B59V9.17.34.D01.1.454.light.4.raw

SEQ ID NO: 542013 - DNA, 488 bp, Homo sapiens
  misc_feature: HIJSMM301C94L9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtaccccctcactttcggcggagggaccaaggcggagatcagacgaactgtggctgcaccatctgtcttcat

SEQ ID NO: 542014 - DNA, 464 bp, Homo sapiens; identical to SEQ ID NO: 536640
  misc_feature: HIJSMM301BE1IQ.26.78.H01.1.454.light.4.raw

SEQ ID NO: 542015 - DNA, 479 bp, Homo sapiens
  misc_feature: HIJSMM301EO4TC.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgttcggccaggggaccaaggtcgaaatgagacgaactgtggctgcaccatctgtt

SEQ ID NO: 542016 - DNA, 499 bp, Homo sapiens; identical to SEQ ID NO: 536578
  misc_feature: HIJSMM301B0KD5.22.27.C05.1.454.light.4.raw

SEQ ID NO: 542017 - DNA, 447 bp, Homo sapiens; identical to SEQ ID NO: 535201
  misc_feature: HIJSMM301DVI0G.18.9.A09.1.454.light.4.raw

SEQ ID NO: 542018 - DNA, 475 bp, Homo sapiens
  misc_feature: HIJSMM301AK05R.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagccccaa

SEQ ID NO: 542019 - DNA, 477 bp, Homo sapiens
  misc_feature: HIJSMM301BEXMG.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtaggaaagtacaaacgaa

SEQ ID NO: 542020 - DNA, 454 bp, Homo sapiens
  misc_feature: HIJSMM301AJ9IY.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgcccctcctccacgagagta

SEQ ID NO: 542021 - DNA, 512 bp, Homo sapiens
  misc_feature: HIJSMM301ADSTY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccgaacggtggaaagtacaaacgaaactacgtggcgtgcaccatctgtcttcatcttccccg

SEQ ID NO: 542022 - DNA, 486 bp, Homo sapiens
  misc_feature: HIJSMM301CKNXR.46.37.D04.1.454.light.4.raw
actagcagtacacgaccggtgctcgatttagtagcatactgttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 542023 - DNA, 517 bp, Homo sapiens
  misc_feature: HIJSMM301AVJPY.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtacggaaagtacaagacgaacgtacgtggctgcgaccactctcgtcttctactcttcccgt

SEQ ID NO: 542024 - DNA, 492 bp, Homo sapiens; identical to SEQ ID NO: 535126
  misc_feature: HIJSMM301AE8GU.18.11.A11.1.454.light.4.raw

SEQ ID NO: 542025 - DNA, 488 bp, Homo sapiens; identical to SEQ ID NO: 537673
  misc_feature: HIJSMM301D8YZK.12.31.C09.1.454.light.4.raw

SEQ ID NO: 542026 - DNA, 513 bp, Homo sapiens; identical to SEQ ID NO: 536917
  misc_feature: HIJSMM301AG1TL.16.83.H06.1.454.light.4.raw

SEQ ID NO: 542027 - DNA, 520 bp, Homo sapiens; identical to SEQ ID NO: 535686
  misc_feature: HIJSMM301AO2JL.41.19.B08.1.454.light.4.raw

SEQ ID NO: 542028 - DNA, 443 bp, Homo sapiens
  misc_feature: HIJSMM301DWGYF.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctccccgtgtctgat

SEQ ID NO: 542029 - DNA, 496 bp, Homo sapiens; identical to SEQ ID NO: 535109
  misc_feature: HIJSMM301AQDST.16.78.H01.1.454.light.4.raw

SEQ ID NO: 542030 - DNA, 490 bp, Homo sapiens; identical to SEQ ID NO: 535420
  misc_feature: HIJSMM301AEFHH.3.72.G06.1.454.light.4.raw

SEQ ID NO: 542031 - DNA, 494 bp, Homo sapiens
  misc_feature: HIJSMM301AQA41.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcaccatctgtt

SEQ ID NO: 542032 - DNA, 484 bp, Homo sapiens
  misc_feature: HIJSMM301EQGGS.47.48.E04.1.454.light.4.raw
agctcacgtacacgaccggtgctcgatttagagagcgtcacagagagaagggggaatcagtcccactcaggacacagcatggacatgagggtccccgctcagctcctggggctcccgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaaggtggaaatacaaacgaaactgtggctgcacc

SEQ ID NO: 542033 - DNA, 482 bp, Homo sapiens
  misc_feature: HIJSMM301BVSOU.11.76.G10.1.454.light.4.raw
cgagagataccacgaccggtgctcgatttagtcactcatacagggggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaa

SEQ ID NO: 542034 - DNA, 511 bp, Homo sapiens
  misc_feature: HIJSMM301BP0QR.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 542035 - DNA, 447 bp, Homo sapiens; identical to SEQ ID NO: 535020
  misc_feature: HIJSMM301B2A3C.18.9.A09.1.454.light.4.raw

SEQ ID NO: 542036 - DNA, 519 bp, Homo sapiens
  misc_feature: HIJSMM301BHT3V.12.5.A05.1.454.light.4.raw
atacgacgtacacgaccggtgctcgatttagatagatagacagggggggtcgtcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactatttctcctggtaccagcaacacccaggcaaagcccccaaactcctcatttatggtgtcgggaatcggccctcaggggtttctaatcgcttctctggctccaagtctggcaaaacggcctccctgaccatctctggactccagcctgaggacgaggccgattactactgcattgcacagacaaggagtcccacttgggtgttcggcggagggaccaaactgaccgtcctaggtcagcccaaggctgccccctcggtcactctgttcccaccctcctct

SEQ ID NO: 542037 - DNA, 510 bp, Homo sapiens
  misc_feature: HIJSMM301CL8KC.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactctgttcccta

SEQ ID NO: 542038 - DNA, 503 bp, Homo sapiens; identical to SEQ ID NO: 535140
  misc_feature: HIJSMM301CRSTE.18.37.D04.1.454.light.4.raw

SEQ ID NO: 542039 - DNA, 502 bp, Homo sapiens
  misc_feature: HIJSMM301B340Q.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 542040 - DNA, 444 bp, Homo sapiens; identical to SEQ ID NO: 534993
  misc_feature: HIJSMM301D8CJG.5.9.A09.1.454.light.4.raw

SEQ ID NO: 542041 - DNA, 502 bp, Homo sapiens; identical to SEQ ID NO: 537816
  misc_feature: HIJSMM301EKXBS.19.78.H01.1.454.light.4.raw

SEQ ID NO: 542042 - DNA, 492 bp, Homo sapiens; identical to SEQ ID NO: 536010
  misc_feature: HIJSMM301BJYJX.10.20.B09.1.454.light.4.raw

SEQ ID NO: 542043 - DNA, 441 bp, Homo sapiens; identical to SEQ ID NO: 534971
  misc_feature: HIJSMM301BS6EA.11.3.A03.1.454.light.4.raw

SEQ ID NO: 542044 - DNA, 455 bp, Homo sapiens; identical to SEQ ID NO: 535447
  misc_feature: HIJSMM301DZMAQ.19.71.G05.1.454.light.4.raw

SEQ ID NO: 542045 - DNA, 499 bp, Homo sapiens
  misc_feature: HIJSMM301EHWAE.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacattttcaccctcaccatcaatagcctggaagctgaagatgctgcaacttattactgtcatcagagtactactttacctcaagtgatcaccttcggccgaagggacacgactggagattaaacgaaactgtggctgcacccaatctgtctt

SEQ ID NO: 542046 - DNA, 514 bp, Homo sapiens
  misc_feature: HIJSMM301B7EB7.43.23.C01.1.454.light.4.raw
tgtgagtagtcacgaccggtgctcgatttagtacacgtgattagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccctcct

SEQ ID NO: 542047 - DNA, 496 bp, Homo sapiens; identical to SEQ ID NO: 537925
  misc_feature: HIJSMM301DC8U8.22.14.B03.1.454.light.4.raw

SEQ ID NO: 542048 - DNA, 486 bp, Homo sapiens
  misc_feature: HIJSMM301EAUF0.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaactgtggctgcacca

SEQ ID NO: 542049 - DNA, 487 bp, Homo sapiens
  misc_feature: HIJSMM301EJ11F.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaa

SEQ ID NO: 542050 - DNA, 486 bp, Homo sapiens; identical to SEQ ID NO: 540808
  misc_feature: HIJSMM301AVRUW.26.70.G04.1.454.light.4.raw

SEQ ID NO: 542051 - DNA, 486 bp, Homo sapiens; identical to SEQ ID NO: 535043
  misc_feature: HIJSMM301B53ES.46.35.D02.1.454.light.4.raw

SEQ ID NO: 542052 - DNA, 489 bp, Homo sapiens
  misc_feature: HIJSMM301CX1BB.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactgtggctgcaccatct

SEQ ID NO: 542053 - DNA, 512 bp, Homo sapiens
  misc_feature: HIJSMM301CADX6.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccgacgggaccgaccgacgtagaaatagagacgaactagtggctgcaccaactctgtcttctatcttcccgt

SEQ ID NO: 542054 - DNA, 487 bp, Homo sapiens; identical to SEQ ID NO: 536206
  misc_feature: HIJSMM301A8NJE.47.38.D05.1.454.light.4.raw

SEQ ID NO: 542055 - DNA, 447 bp, Homo sapiens; identical to SEQ ID NO: 535201
  misc_feature: HIJSMM301AWZBS.18.9.A09.1.454.light.4.raw

SEQ ID NO: 542056 - DNA, 493 bp, Homo sapiens
  misc_feature: HIJSMM301AG3A3.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactagtggctgcaccatctgtcttc

SEQ ID NO: 542057 - DNA, 480 bp, Homo sapiens; identical to SEQ ID NO: 535442
  misc_feature: HIJSMM301A9IUJ.41.17.B06.1.454.light.4.raw

SEQ ID NO: 542058 - DNA, 462 bp, Homo sapiens
  misc_feature: HIJSMM301BD5LD.48.23.C01.1.454.light.4.raw
agtatacatacacgaccggtgctcgatttagtacacgtgattagggattgggggctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 542059 - DNA, 495 bp, Homo sapiens; identical to SEQ ID NO: 535007
  misc_feature: HIJSMM301DQ80F.22.5.A05.1.454.light.4.raw

SEQ ID NO: 542060 - DNA, 496 bp, Homo sapiens
  misc_feature: HIJSMM301ENZ4Z.3.23.C01.1.454.light.4.raw
agacgcactccacgaccggtgctcgatttagtacacgtgattagggattgggggagctgctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtgcatccaacagggccactggcatcccagacaggttcagtggcagtgggtctggaacagacttcactctcaccatcagcagactggagcctgaagactttgcagtttattactgtctgcagtatggtacttcactcttggtcaatttcggcggcgggaccaaggtggagatcaaacgaactgtggctgcaccatctgtctt

SEQ ID NO: 542061 - DNA, 489 bp, Homo sapiens
  misc_feature: HIJSMM301B6RCX.15.8.A08.1.454.light.4.raw
tctacgtagccacgaccggtgctcgatttagcatactctacagggggaggaactgctcagttaggacccagacggaaccatggaagccccagcgcagcttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcat

SEQ ID NO: 542062 - DNA, 486 bp, Homo sapiens; identical to SEQ ID NO: 535043
  misc_feature: HIJSMM301D5RSK.46.35.D02.1.454.light.4.raw

SEQ ID NO: 542063 - DNA, 503 bp, Homo sapiens; identical to SEQ ID NO: 537518
  misc_feature: HIJSMM301BU9TY.8.19.B08.1.454.light.4.raw

SEQ ID NO: 542064 - DNA, 480 bp, Homo sapiens
  misc_feature: HIJSMM301CI7B6.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcacttttcggcggagggaccaaggtggagatcaaacgaactgtggctgca

SEQ ID NO: 542065 - DNA, 487 bp, Homo sapiens; identical to SEQ ID NO: 536536
  misc_feature: HIJSMM301D81TM.26.45.E01.1.454.light.4.raw

SEQ ID NO: 542066 - DNA, 497 bp, Homo sapiens
  misc_feature: HIJSMM301ALJJT.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaactagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 542067 - DNA, 505 bp, Homo sapiens
  misc_feature: HIJSMM301E22E2.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttcccgccct

SEQ ID NO: 542068 - DNA, 484 bp, Homo sapiens; identical to SEQ ID NO: 535400
  misc_feature: HIJSMM301A44U5.46.26.C04.1.454.light.4.raw

SEQ ID NO: 542069 - DNA, 487 bp, Homo sapiens
  misc_feature: HIJSMM301CL149.41.12.B01.1.454.light.4.raw
tctatactatcacgaccggtgctcgatttagtagtgtagattccgcggggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaaccctaatctatgctgcatccactttgcgaagtggggtcccgtcaaagttcagcggcggcagatctgggacagacttcactctcaccatcagcaacctgcagcctgaagattttgcaacttattactgccaacaatacagcacgtttcccctctactttcggcggagggaccagggtggagatcaaacgaactgtggctgcaccatctgtctt

SEQ ID NO: 542070 - DNA, 496 bp, Homo sapiens
  misc_feature: HIJSMM301AYAOI.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcacca

SEQ ID NO: 542071 - DNA, 494 bp, Homo sapiens; identical to SEQ ID NO: 534992
  misc_feature: HIJSMM301D6JSM.9.1.A01.1.454.light.4.raw

SEQ ID NO: 542072 - DNA, 503 bp, Homo sapiens; identical to SEQ ID NO: 538884
  misc_feature: HIJSMM301D2NPM.27.78.H01.1.454.light.4.raw

SEQ ID NO: 542073 - DNA, 507 bp, Homo sapiens; identical to SEQ ID NO: 535930
  misc_feature: HIJSMM301ARO8F.15.34.D01.1.454.light.4.raw

SEQ ID NO: 542074 - DNA, 479 bp, Homo sapiens
  misc_feature: HIJSMM301EMD1G.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccggacgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtgg

SEQ ID NO: 542075 - DNA, 510 bp, Homo sapiens
  misc_feature: HIJSMM301AMABD.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgtggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttccca

SEQ ID NO: 542076 - DNA, 487 bp, Homo sapiens; identical to SEQ ID NO: 537079
  misc_feature: HIJSMM301DT4VB.14.55.E11.1.454.light.4.raw

SEQ ID NO: 542077 - DNA, 489 bp, Homo sapiens
  misc_feature: HIJSMM301A0GWZ.51.6.A06.1.454.light.4.raw
cgatcgtatacacgaccggtgctcgatttagatctactgacagggggtgggtccaggaggcagaactctgggtgtctcgccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcact

SEQ ID NO: 542078 - DNA, 519 bp, Homo sapiens
  misc_feature: HIJSMM301B9UF3.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtgt

SEQ ID NO: 542079 - DNA, 486 bp, Homo sapiens
  misc_feature: HIJSMM301BC1N0.41.33.C11.1.454.light.4.raw
tctatactatcacgaccggtgctcgatttagagtgagctcgttgggtttgggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaagtggattcaaacgaactgtggctgcacc

SEQ ID NO: 542080 - DNA, 415 bp, Homo sapiens; identical to SEQ ID NO: 536113
  misc_feature: HIJSMM301AIO67.18.78.H01.1.454.light.4.raw

SEQ ID NO: 542081 - DNA, 493 bp, Homo sapiens
  misc_feature: HIJSMM301AIFTS.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccgaaggtggaaatacagacgaactgtggctgcaccatctgtcttcta

SEQ ID NO: 542082 - DNA, 455 bp, Homo sapiens
  misc_feature: HIJSMM301ESLKE.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgaccctcctccacgagagta

SEQ ID NO: 542083 - DNA, 482 bp, Homo sapiens
  misc_feature: HIJSMM301C50TZ.5.39.D06.1.454.light.4.raw
atcagacacgcacgaccggtgctcgatttagtgacatctcgcagttctttggggaggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcacc

SEQ ID NO: 542084 - DNA, 517 bp, Homo sapiens
  misc_feature: HIJSMM301AHIQ4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccattagcagcctgcaggctgaagatgtggcagtttattactgtcaacagttttctcgggcgttcggtccaacgggaccgaacggtaggaaagtacaaacgaaactagtaggtcgtgcaccaatctgtcttctactcttcccgt

SEQ ID NO: 542085 - DNA, 470 bp, Homo sapiens
  misc_feature: HIJSMM301A2OLK.49.73.G07.1.454.light.4.raw
agtcgagagacacgaccggtgctcgatttagctctacgctcagggcacgaccggtgctcgatttagctcgatatagttgggtttggggagtcagtctcagtcaggacacagcatggacatgagggtccccgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgataatctcccgctctacg

SEQ ID NO: 542086 - DNA, 496 bp, Homo sapiens; identical to SEQ ID NO: 535109
  misc_feature: HIJSMM301ANJWB.16.78.H01.1.454.light.4.raw

SEQ ID NO: 542087 - DNA, 444 bp, Homo sapiens; identical to SEQ ID NO: 535192
  misc_feature: HIJSMM301C47UZ.5.9.A09.1.454.light.4.raw

SEQ ID NO: 542088 - DNA, 493 bp, Homo sapiens
  misc_feature: HIJSMM301C4FPL.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcat

SEQ ID NO: 542089 - DNA, 444 bp, Homo sapiens
  misc_feature: HIJSMM301BDS69.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 542090 - DNA, 502 bp, Homo sapiens
  misc_feature: HIJSMM301BHSHT.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtcttggt

SEQ ID NO: 542091 - DNA, 486 bp, Homo sapiens; identical to SEQ ID NO: 537428
  misc_feature: HIJSMM301DPRV4.47.62.F07.1.454.light.4.raw

SEQ ID NO: 542092 - DNA, 503 bp, Homo sapiens; identical to SEQ ID NO: 540136
  misc_feature: HIJSMM301CS3T2.19.10.A10.1.454.light.4.raw

SEQ ID NO: 542093 - DNA, 457 bp, Homo sapiens
  misc_feature: HIJSMM301BD2AI.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgttcccaccctcctctagtacgtga

SEQ ID NO: 542094 - DNA, 491 bp, Homo sapiens; identical to SEQ ID NO: 535194
  misc_feature: HIJSMM301BKNI4.26.78.H01.1.454.light.4.raw

SEQ ID NO: 542095 - DNA, 444 bp, Homo sapiens; identical to SEQ ID NO: 535192
  misc_feature: HIJSMM301EC936.5.9.A09.1.454.light.4.raw

SEQ ID NO: 542096 - DNA, 487 bp, Homo sapiens; identical to SEQ ID NO: 536536
  misc_feature: HIJSMM301EMA1K.26.45.E01.1.454.light.4.raw

SEQ ID NO: 542097 - DNA, 509 bp, Homo sapiens
  misc_feature: HIJSMM301C9KWY.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtctttatcttccccg

SEQ ID NO: 542098 - DNA, 489 bp, Homo sapiens
  misc_feature: HIJSMM301CL6OH.13.10.A10.1.454.light.4.raw
tcacgtactacacgaccggtgctcgatttagcgtcgatctcaggggctgggcctcaggaagcagcatcggaggtgcctcagccatggcatggatccctctcttcctcggcgtccttgcttactgcacaggatcggtggcctcgaatggcctgactcagccacccgcaatgtccgtgtccccagggcagacagccaccataacctgctctggatatttgttgagggatagatatgcttgttggtatcaacagaaggccggccagtcacctacattggttatctatgaagacacgaagcggccctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtca

SEQ ID NO: 542099 - DNA, 472 bp, Homo sapiens
  misc_feature: HIJSMM301D1PG4.52.49.E05.1.454.light.4.raw
cgcagtacgacacgaccggtgctcgatttagagcgactagcaacacacaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtgggtcccatcaaggttcagtggcagtggatctgggacagacttcactctcaccatcagcagtctgcaacctgaggattttgccacttactactgtcaacagacttacaatacccctccatacacttttggccaggggacccaagctggagatcagaacg

SEQ ID NO: 542100 - DNA, 494 bp, Homo sapiens; identical to SEQ ID NO: 534994
  misc_feature: HIJSMM301DYO18.27.78.H01.1.454.light.4.raw

SEQ ID NO: 542101 - DNA, 501 bp, Homo sapiens
  misc_feature: HIJSMM301A41TR.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccg

SEQ ID NO: 542102 - DNA, 483 bp, Homo sapiens
  misc_feature: HIJSMM301C173C.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctggacgttcggccaagggaccaaggtggaaatacaaacgaactgtggctgcaccatctgtcttcta

SEQ ID NO: 542103 - DNA, 501 bp, Homo sapiens
  misc_feature: HIJSMM301E0FUY.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccgcc

SEQ ID NO: 542104 - DNA, 506 bp, Homo sapiens
  misc_feature: HIJSMM301ERRBH.48.80.H03.1.454.light.4.raw
  modified_base (377)..(377): a, c, t, g, unknown or other
agtatacatacacgaccggtgctcgatttagctgtgcgtcgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttattactgtcaacaatattaattatactccgccgacgtcggtccggggaccgaacgtcggaaatacaaaacgaactagtggctgcaccat

SEQ ID NO: 542105 - DNA, 502 bp, Homo sapiens
  misc_feature: HIJSMM301D580F.2.76.G10.1.454.light.4.raw
  modified_base (467)..(467): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttanctcttcggacctgggaccaaggtcaccgtcttggt

SEQ ID NO: 542106 - DNA, 444 bp, Homo sapiens; identical to SEQ ID NO: 535027
  misc_feature: HIJSMM301D8QEX.8.73.G07.1.454.light.4.raw

SEQ ID NO: 542107 - DNA, 503 bp, Homo sapiens
  misc_feature: HIJSMM301EKLAG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaacgaactagtggctgcaccatctgtcttcatttcccgt

SEQ ID NO: 542108 - DNA, 497 bp, Homo sapiens
  misc_feature: HIJSMM301AMMB9.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgtgcagcatactatgacaccctgaatggtctttgggtgttcggcggagggaccaagctgaccgtcctaggtcacg

SEQ ID NO: 542109 - DNA, 496 bp, Homo sapiens; identical to SEQ ID NO: 535109
  misc_feature: HIJSMM301BL1FB.16.78.H01.1.454.light.4.raw

SEQ ID NO: 542110 - DNA, 504 bp, Homo sapiens
  misc_feature: HIJSMM301CABSL.49.30.C08.1.454.light.4.raw
agtcgagagacacgaccggtgctcgatttagtctgacgtcaaagggaaagggggcatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 542111 - DNA, 492 bp, Homo sapiens
  misc_feature: HIJSMM301A7OC3.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatct

SEQ ID NO: 542112 - DNA, 487 bp, Homo sapiens; identical to SEQ ID NO: 537009
  misc_feature: HIJSMM301BAPCF.12.88.H11.1.454.light.4.raw

SEQ ID NO: 542113 - DNA, 445 bp, Homo sapiens; identical to SEQ ID NO: 536070
  misc_feature: HIJSMM301DLJ4Q.5.9.A09.1.454.light.4.raw

SEQ ID NO: 542114 - DNA, 490 bp, Homo sapiens; identical to SEQ ID NO: 538361
  misc_feature: HIJSMM301B8V1M.47.55.E11.1.454.light.4.raw

SEQ ID NO: 542115 - DNA, 496 bp, Homo sapiens
  misc_feature: HIJSMM301BJZRL.16.75.G09.1.454.light.4.raw
tgtactactccacgaccggtgctcgatttagtatagacatcaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtaggtcgttataactatgtctcctggtaccaacaacacccaggcaacgcccccacggctcatgatttatgaggtcaatgatcggccctcaggaatttccaatcgcttctctggctccaagtctggcaacacggcctccctgacaatctctgacctccagcctgaggacgaggctgaatattactgcagttcatatacaactaagagtcttgtggtattcggcggagggaccaagctgacagtcctaggtcagcccaaggctgccccctc

SEQ ID NO: 542116 - DNA, 447 bp, Homo sapiens; identical to SEQ ID NO: 535020
  misc_feature: HIJSMM301AOCVP.18.9.A09.1.454.light.4.raw

SEQ ID NO: 542117 - DNA, 494 bp, Homo sapiens; identical to SEQ ID NO: 534994
  misc_feature: HIJSMM301D7VSP.27.78.H01.1.454.light.4.raw

SEQ ID NO: 542118 - DNA, 503 bp, Homo sapiens
  misc_feature: HIJSMM301AYTSY.48.28.C06.1.454.light.4.raw
agtatacatacacgaccggtgctcgatttagagctcacgtattgggtttgggggtgggctcaggaggcagagctctgggaatctcaccatggcctggacccctctcctgctccccctcctcacttctgcacagtctctgaggcctcctatgagctgacacagccaccctcggtgtcagtgtccccacggacaaacggccaggatcacctgctctggagatgcattgccaaaaaataatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 542119 - DNA, 505 bp, Homo sapiens
  misc_feature: HIJSMM301DPV19.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggttcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactacttttggccgaggggaccaagctggagagtacaaacgaactgtggctgcaccatctgtctt

SEQ ID NO: 542120 - DNA, 488 bp, Homo sapiens
  misc_feature: HIJSMM301AMWW6.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatggttggggtttattactgcatgcaagttctacaaacttcctacacttttggccaggggaccaagctggagatcaaacgaa

SEQ ID NO: 542121 - DNA, 507 bp, Homo sapiens
  misc_feature: HIJSMM301CAG7D.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagtctttgtcttcggaagtgggaccaaggtcaccgtcctaagtcagcccaaggccaaccccactgtcactctcgttcccgccctt

SEQ ID NO: 542122 - DNA, 447 bp, Homo sapiens; identical to SEQ ID NO: 535020
  misc_feature: HIJSMM301CAL71.18.9.A09.1.454.light.4.raw

SEQ ID NO: 542123 - DNA, 495 bp, Homo sapiens
  misc_feature: HIJSMM301DHF9F.16.68.G02.1.454.light.4.raw
  modified_base (461)..(461): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtcctgatatatgagacttctactttagaaagtggggtcccatcaaaggttcagcggcagtggatctgggacagaattcactctcactatcaccagcctgcaacctgatgattttgcaacttattactgccaacagtatcatcatcattgtaatttcggtggagggaccaaaggtggaggtnaaaacgaactgtggctgcaccatctgtcttcatt

SEQ ID NO: 542124 - DNA, 465 bp, Homo sapiens
  misc_feature: HIJSMM301ANZ9F.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 542125 - DNA, 495 bp, Homo sapiens
  misc_feature: HIJSMM301APWPA.4.57.F02.1.454.light.4.raw
agcactgtagcacgaccggtgctcgatttagctcgatatagttgggtttggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgataccccctccgcctcacctttcggtcggagggaccgaaggtaggagatcaaacgaacctagtggctgcaccatctgtt

SEQ ID NO: 542126 - DNA, 494 bp, Homo sapiens
  misc_feature: HIJSMM301DGQ20.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggacgaacggtggagttctaacgaactgtggctgcaccatctgtcttcat

SEQ ID NO: 542127 - DNA, 381 bp, Homo sapiens
  misc_feature: HIJSMM301BZK7S.49.69.G03.1.454.light.4.raw
agtcgagagacacgaccggtgctcgatttagtcgctgcgtaaaggagaaagggggctgggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgat

SEQ ID NO: 542128 - DNA, 522 bp, Homo sapiens
  misc_feature: HIJSMM301AQD47.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaaactagtggcgtgcaccactctgtcttctactcttcccgtccact

SEQ ID NO: 542129 - DNA, 503 bp, Homo sapiens; identical to SEQ ID NO: 537189
  misc_feature: HIJSMM301B5YIB.19.85.H08.1.454.light.4.raw

SEQ ID NO: 542130 - DNA, 489 bp, Homo sapiens; identical to SEQ ID NO: 535139
  misc_feature: HIJSMM301EGMOO.14.55.E11.1.454.light.4.raw

SEQ ID NO: 542131 - DNA, 503 bp, Homo sapiens
  misc_feature: HIJSMM301AYD1O.48.30.C08.1.454.light.4.raw
agtatacatacacgaccggtgctcgatttagtctgacgtcaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcacca

SEQ ID NO: 542132 - DNA, 495 bp, Homo sapiens; identical to SEQ ID NO: 536020
  misc_feature: HIJSMM301AWVLQ.41.38.D05.1.454.light.4.raw

SEQ ID NO: 542133 - DNA, 513 bp, Homo sapiens
  misc_feature: HIJSMM301BKQOH.14.78.H01.1.454.light.4.raw
cgtctagtaccacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 542134 - DNA, 494 bp, Homo sapiens; identical to SEQ ID NO: 538539
  misc_feature: HIJSMM301DH6G6.43.29.C07.1.454.light.4.raw

SEQ ID NO: 542135 - DNA, 454 bp, Homo sapiens; identical to SEQ ID NO: 534964
  misc_feature: HIJSMM301BZ0YL.19.86.H09.1.454.light.4.raw

SEQ ID NO: 542136 - DNA, 518 bp, Homo sapiens
  misc_feature: HIJSMM301A1EEI.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctctccgt

SEQ ID NO: 542137 - DNA, 487 bp, Homo sapiens
  misc_feature: HIJSMM301E1ILR.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccaggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactaccctctcactttcggcggggacggaacgtaggagatacaaccgaaacgtactggcgtcgtcacca

SEQ ID NO: 542138 - DNA, 504 bp, Homo sapiens
  misc_feature: HIJSMM301CGMXH.22.9.A09.1.454.light.4.raw
  modified_base (498)..(498): a, c, t, g, unknown or other
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggtccgacggggcggacagtgaggatcagaacggaacctagtggcgtcgcacccaactcttcgtnttacct

SEQ ID NO: 542139 - DNA, 494 bp, Homo sapiens; identical to SEQ ID NO: 534994
  misc_feature: HIJSMM301AQLJ7.27.78.H01.1.454.light.4.raw

SEQ ID NO: 542140 - DNA, 484 bp, Homo sapiens; identical to SEQ ID NO: 535240
  misc_feature: HIJSMM301D1SK5.47.60.F05.1.454.light.4.raw

SEQ ID NO: 542141 - DNA, 507 bp, Homo sapiens
  misc_feature: HIJSMM301EN999.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccgaaggtggaaatacaaacgaactagtggctgcaccatctgtcttcatcttccccg

SEQ ID NO: 542142 - DNA, 444 bp, Homo sapiens; identical to SEQ ID NO: 535856
  misc_feature: HIJSMM301B3XKF.9.9.A09.1.454.light.4.raw

SEQ ID NO: 542143 - DNA, 445 bp, Homo sapiens
  misc_feature: HIJSMM301BS9ZF.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgccctcctctacgtgagct

SEQ ID NO: 542144 - DNA, 520 bp, Homo sapiens
  misc_feature: HIJSMM301CWC6J.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 542145 - DNA, 475 bp, Homo sapiens
  misc_feature: HIJSMM301EP4PP.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 542146 - DNA, 484 bp, Homo sapiens
  misc_feature: HIJSMM301DHBPD.52.83.H06.1.454.light.4.raw
cgcagtacgacacgaccggtgctcgatttagatcacgtgcgtcgcgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccat

SEQ ID NO: 542147 - DNA, 485 bp, Homo sapiens
  misc_feature: HIJSMM301DXMKU.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagttcaccatcagcagcctgcagcctgaagatattggaacatattactgtcaacagtatgataatttaccgctcactttcggcggaggaccaaggtggacatcaaacgaactgtggctgcaccat

SEQ ID NO: 542148 - DNA, 486 bp, Homo sapiens
  misc_feature: HIJSMM301C8H4P.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtgggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 542149 - DNA, 485 bp, Homo sapiens
  misc_feature: HIJSMM301EDACV.51.73.G07.1.454.light.4.raw
cgatcgtatacacgaccggtgctcgatttagctctacgctcagggggcaggagtcagtctcagtcaggacacagcatggacatgagggtccccgctcagctcctggggctcctgctactctggctccgaggtgccagatgtgccatccagttgacccagtctccatcctccctgtctgcatctgttggagaagtagtcgccatcacttgccagacaagacagacccttagtacatatttaaactggtatcaacagaagccagggaggccccctaaactcataatctatggtgcctccactttgcaaagtggagtcccgtcaaggttcagtggcactggagctgggacagatttcagtctcgtcatccacggcctgcaacttgaggatgttgcgacttactactgtcaagaggctgccactattcctccgtacacttttcggccaggggaccaaggtggagatcagacgaactgtggctgcaccat

SEQ ID NO: 542150 - DNA, 485 bp, Homo sapiens
  misc_feature: HIJSMM301BW0ET.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggaggaccaaggtggagatcaaacgaactgtggctgcaccat

SEQ ID NO: 542151 - DNA, 454 bp, Homo sapiens; identical to SEQ ID NO: 534964
  misc_feature: HIJSMM301CVKJY.19.86.H09.1.454.light.4.raw

SEQ ID NO: 542152 - DNA, 504 bp, Homo sapiens
  misc_feature: HIJSMM301EPX3P.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtggaaatacaaacgaactagtggctgcaccatctgtcttctatcttccccg

SEQ ID NO: 542153 - DNA, 447 bp, Homo sapiens; identical to SEQ ID NO: 535201
  misc_feature: HIJSMM301D0W2V.18.9.A09.1.454.light.4.raw

SEQ ID NO: 542154 - DNA, 517 bp, Homo sapiens
  misc_feature: HIJSMM301DJR1S.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaaggcgggacccagaccctggagcctcagttggaagcagccgatccagcctggcggagcctgtggggcaggtcagcccaaggctgccccctcggtcactctcgtcccgcctcctccacg

SEQ ID NO: 542155 - DNA, 476 bp, Homo sapiens; identical to SEQ ID NO: 538611
  misc_feature: HIJSMM301AP3XY.7.81.H04.1.454.light.4.raw

SEQ ID NO: 542156 - DNA, 453 bp, Homo sapiens; identical to SEQ ID NO: 535173
  misc_feature: HIJSMM301EVA79.19.86.H09.1.454.light.4.raw

SEQ ID NO: 542157 - DNA, 508 bp, Homo sapiens
  misc_feature: HIJSMM301BC927.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaaggtaggaaagtacaaacgaactagtggctgcaccatctgtcttcatcttcccg

SEQ ID NO: 542158 - DNA, 418 bp, Homo sapiens
  misc_feature: HIJSMM301AJFKO.18.78.H01.1.454.light.4.raw
tacgagtatgcacgaccggtgctcgatttagtgtgagtagtttgggtttggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 542159 - DNA, 491 bp, Homo sapiens; identical to SEQ ID NO: 535294
  misc_feature: HIJSMM301BAS7N.16.68.G02.1.454.light.4.raw

SEQ ID NO: 542160 - DNA, 507 bp, Homo sapiens; identical to SEQ ID NO: 541461
  misc_feature: HIJSMM301BKHI9.11.57.F02.1.454.light.4.raw

SEQ ID NO: 542161 - DNA, 489 bp, Homo sapiens; identical to SEQ ID NO: 539323
  misc_feature: HIJSMM301AV932.49.46.E02.1.454.light.4.raw

SEQ ID NO: 542162 - DNA, 507 bp, Homo sapiens
  misc_feature: HIJSMM301BYU9A.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccaactgtcta

SEQ ID NO: 542163 - DNA, 441 bp, Homo sapiens
  misc_feature: HIJSMM301BX61M.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttctcgccctcctcgtatctctcg

SEQ ID NO: 542164 - DNA, 520 bp, Homo sapiens; identical to SEQ ID NO: 535773
  misc_feature: HIJSMM301AI4TL.41.19.B08.1.454.light.4.raw

SEQ ID NO: 542165 - DNA, 507 bp, Homo sapiens
  misc_feature: HIJSMM301DRRZ6.51.34.D01.1.454.light.4.raw
cgatcgtatacacgaccggtgctcgatttagatcgtctgtgttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttc

SEQ ID NO: 542166 - DNA, 504 bp, Homo sapiens
  misc_feature: HIJSMM301CLV5Z.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccaaggtggaaatacaaacgaactagtggctgcaccatctgtcttcatcttccccg

SEQ ID NO: 542167 - DNA, 507 bp, Homo sapiens
  misc_feature: HIJSMM301C8WM1.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaactttactactgtcaacagagtttcagttgtcccccggacgttcggtccagggaccgacacgtagaaatagagacgaactgtggctgcaccatctgtcttctatcttcccgt

SEQ ID NO: 542168 - DNA, 482 bp, Homo sapiens
  misc_feature: HIJSMM301E1KR8.5.7.A07.1.454.light.4.raw
atcagacacgcacgaccggtgctcgatttagcacgtgtcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgccgggcaagtcagaacattaccacctatttacattggtatctgcagaagccagggagagcccctaagctcctgatctatgcttcatccaatttgcacagtggggtcccgtcaaggttcagtggcggtggctctgagacagattttcactctcaccatcagcagtctgcaacctgaagattttgcaacttactactgtcaacagagttaccggtaccccctcactttcggcggagggaccaaggttgagatcaaacgaactgtggctgcaccta

SEQ ID NO: 542169 - DNA, 444 bp, Homo sapiens; identical to SEQ ID NO: 535411
  misc_feature: HIJSMM301EZ0OS.8.73.G07.1.454.light.4.raw

SEQ ID NO: 542170 - DNA, 515 bp, Homo sapiens
  misc_feature: HIJSMM301CVM5D.48.82.H05.1.454.light.4.raw
agtatacatacacgaccggtgctcgatttagtcgagctctctcgcgggcacgaccggtgctcgatttagtcgctgcgtaaaggagaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtccg

SEQ ID NO: 542171 - DNA, 478 bp, Homo sapiens
  misc_feature: HIJSMM301AN9EV.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagttttggccaggggaccaagctggagatcaaacga

SEQ ID NO: 542172 - DNA, 495 bp, Homo sapiens
  misc_feature: HIJSMM301E14T0.51.81.H04.1.454.light.4.raw
cgatcgtatacacgaccggtgctcgatttagtagtgtagattcgcgggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttattgcttcggaactgcgaccaaggtcaccgtcctgggtcagcccaaggccaaccccacctgtcact

SEQ ID NO: 542173 - DNA, 491 bp, Homo sapiens; identical to SEQ ID NO: 535294
  misc_feature: HIJSMM301BV0PR.16.68.G02.1.454.light.4.raw

SEQ ID NO: 542174 - DNA, 507 bp, Homo sapiens
  misc_feature: HIJSMM301EERQ8.18.26.C04.1.454.light.4.raw
tacgagtatgcacgaccggtgctcgatttagtctagcgactttgggtttggggggtcgagacccacgtcgggacgacagcatggacatgagggtccccggcctcagctcctggggcgtcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaaccctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggaggaccaaggtagagatcaaaggaactgtggctgcaccatctgtcttctatcttcccgcca

SEQ ID NO: 542175 - DNA, 488 bp, Homo sapiens
  misc_feature: HIJSMM301EOTCS.48.27.C05.1.454.light.4.raw
agtatacatacacgaccggtgctcgatttagacgcgatcgaagggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcg

SEQ ID NO: 542176 - DNA, 493 bp, Homo sapiens
  misc_feature: HIJSMM301AYZTD.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggtggctgaggatgttggggtttgttcctccatgcaaggtacacactggccttttggccaggggaccaacctggagatcaaatgaactgtggctgcaccatctgtctt

SEQ ID NO: 542177 - DNA, 502 bp, Homo sapiens
  misc_feature: HIJSMM301EP5YW.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggacgtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 542178 - DNA, 479 bp, Homo sapiens
  misc_feature: HIJSMM301B6NMM.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctgaccagcctcccaggcccctcatctatgctgcatccgccagggccactggtatcccagccaggttcagtggcagtgggtctgggacagacttcactctcaccatcagcagcctgcagtctgaagattttgcagtttattactgtcagcagtatgatgactggcctcagacgttcggccaagggaccaaggtggaagtcaaacgaactgtggctgcaccat

SEQ ID NO: 542179 - DNA, 513 bp, Homo sapiens
  misc_feature: HIJSMM301AL6CD.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcctt

SEQ ID NO: 542180 - DNA, 444 bp, Homo sapiens; identical to SEQ ID NO: 540477
  misc_feature: HIJSMM301BP21R.17.21.B10.1.454.light.4.raw

SEQ ID NO: 542181 - DNA, 340 bp, Homo sapiens
  misc_feature: HIJSMM301BC4QB.49.73.G07.1.454.light.4.raw
agtcgagagacacgaccggtgctcgatttagctctacgctcagggcacgaccggtgctcgatttagtgagtcagtaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccgccctcctctctctcgact

SEQ ID NO: 542182 - DNA, 454 bp, Homo sapiens; identical to SEQ ID NO: 535005
  misc_feature: HIJSMM301ALXJQ.19.86.H09.1.454.light.4.raw

SEQ ID NO: 542183 - DNA, 502 bp, Homo sapiens
  misc_feature: HIJSMM301ER00S.52.34.D01.1.454.light.4.raw
cgcagtacgacacgaccggtgctcgatttagatcgtctgtgttgggtttgggggctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcggcagcctagagcctgaagattttgcagtttattactgtcagcagcgtagcaactggcctccgatcaccttcggccaagggacacgactggagattaaacgaactgtggctgcaccatctgtcttcatcttcccgccat

SEQ ID NO: 542184 - DNA, 478 bp, Homo sapiens
  misc_feature: HIJSMM301CRQRJ.48.53.E09.1.454.light.4.raw
agtatacatacacgaccggtgctcgatttagagagagtgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccg

SEQ ID NO: 542185 - DNA, 495 bp, Homo sapiens; identical to SEQ ID NO: 536316
  misc_feature: HIJSMM301DBDU7.40.23.C01.1.454.light.4.raw

SEQ ID NO: 542186 - DNA, 484 bp, Homo sapiens; identical to SEQ ID NO: 535400
  misc_feature: HIJSMM301DMP38.46.26.C04.1.454.light.4.raw

SEQ ID NO: 542187 - DNA, 483 bp, Homo sapiens
  misc_feature: HIJSMM301ALO8S.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactgacctctcactttcggcggagggaccagggtggagatcagacgaa

SEQ ID NO: 542188 - DNA, 494 bp, Homo sapiens
  misc_feature: HIJSMM301CWOZU.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaagtccttacacttttggccaggggaccaagctggagatcaaacgaactgtggc

SEQ ID NO: 542189 - DNA, 498 bp, Homo sapiens
  misc_feature: HIJSMM301CBCLF.10.79.H02.1.454.light.4.raw
catagtagtgcacgaccggtgctcgatttagtgtcacacgaagggaaagggggaagagctgctcagttaggacccagagggaaccatggaaaccccacgcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctggggacagacttcactctcaccatcagcagactggagtctgaagattttgcagtgtattattgtcagcaatatggtaggtcacctgggacttttggccgaggggaccaagctggagatcaaacgaactgtggctgcaccatctgtctt

SEQ ID NO: 542190 - DNA, 487 bp, Homo sapiens
  misc_feature: HIJSMM301B2P6C.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccgaaggtggagatcaaacgaacg

SEQ ID NO: 542191 - DNA, 499 bp, Homo sapiens
  misc_feature: HIJSMM301BKITK.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtccaccgtcctaggtcagccccaaggcccaacccca

SEQ ID NO: 542192 - DNA, 480 bp, Homo sapiens; identical to SEQ ID NO: 535291
  misc_feature: HIJSMM301B73JQ.22.59.F04.1.454.light.4.raw

SEQ ID NO: 542193 - DNA, 503 bp, Homo sapiens; identical to SEQ ID NO: 540136
  misc_feature: HIJSMM301BN5XR.19.10.A10.1.454.light.4.raw

SEQ ID NO: 542194 - DNA, 510 bp, Homo sapiens
  misc_feature: HIJSMM301A84MG.18.37.D04.1.454.light.4.raw
tacgagtatgcacgaccggtgctcgatttagtagcatactggttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaacctagtggctgcaccatctgtt

SEQ ID NO: 542195 - DNA, 487 bp, Homo sapiens; identical to SEQ ID NO: 535069
  misc_feature: HIJSMM301DWMHU.26.23.C01.1.454.light.4.raw

SEQ ID NO: 542196 - DNA, 490 bp, Homo sapiens
  misc_feature: HIJSMM301BFI5T.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaaacttccttacactttttggccaggggaccaagctggagatcaaacgaa

SEQ ID NO: 542197 - DNA, 506 bp, Homo sapiens; identical to SEQ ID NO: 541085
  misc_feature: HIJSMM301DHAWH.16.46.E02.1.454.light.4.raw

SEQ ID NO: 542198 - DNA, 447 bp, Homo sapiens; identical to SEQ ID NO: 535201
  misc_feature: HIJSMM301CVW6Q.18.9.A09.1.454.light.4.raw

SEQ ID NO: 542199 - DNA, 490 bp, Homo sapiens
  misc_feature: HIJSMM301DOJ4T.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatataatttatacttcgtggacgttcggccaagggacccaaaggtggataatcagacgaa

SEQ ID NO: 542200 - DNA, 483 bp, Homo sapiens
  misc_feature: HIJSMM301EPYVH.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatct

SEQ ID NO: 542201 - DNA, 485 bp, Homo sapiens
  misc_feature: HIJSMM301E3RNP.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctcagcgttcgccagggaccaaggtggaagtcaagcgaactgtggctgcaccatctgtt

SEQ ID NO: 542202 - DNA, 500 bp, Homo sapiens
  misc_feature: HIJSMM301DG8J3.52.35.D02.1.454.light.4.raw
cgcagtacgacacgaccggtgctcgatttagcacacgatagttgggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 542203 - DNA, 486 bp, Homo sapiens; identical to SEQ ID NO: 535043
  misc_feature: HIJSMM301DF9OJ.46.35.D02.1.454.light.4.raw

SEQ ID NO: 542204 - DNA, 504 bp, Homo sapiens; identical to SEQ ID NO: 535709
  misc_feature: HIJSMM301CTM76.9.55.E11.1.454.light.4.raw

SEQ ID NO: 542205 - DNA, 486 bp, Homo sapiens; identical to SEQ ID NO: 535043
  misc_feature: HIJSMM301DKFC9.46.35.D02.1.454.light.4.raw

SEQ ID NO: 542206 - DNA, 497 bp, Homo sapiens
  misc_feature: HIJSMM301C17X7.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 542207 - DNA, 484 bp, Homo sapiens; identical to SEQ ID NO: 535400
  misc_feature: HIJSMM301ANZZ7.46.26.C04.1.454.light.4.raw

SEQ ID NO: 542208 - DNA, 461 bp, Homo sapiens
  misc_feature: HIJSMM301E062J.22.28.C06.1.454.light.4.raw
  modified_base (443)..(443): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggcctgccccctcggtcactctgttcccnccctcctcacgcgtatgt

SEQ ID NO: 542209 - DNA, 485 bp, Homo sapiens; identical to SEQ ID NO: 536576
  misc_feature: HIJSMM301AIQKJ.46.35.D02.1.454.light.4.raw

SEQ ID NO: 542210 - DNA, 498 bp, Homo sapiens; identical to SEQ ID NO: 536173
  misc_feature: HIJSMM301CJLUA.12.86.H09.1.454.light.4.raw

SEQ ID NO: 542211 - DNA, 484 bp, Homo sapiens
  misc_feature: HIJSMM301CX0MP.13.36.D03.1.454.light.4.raw
tcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 542212 - DNA, 506 bp, Homo sapiens
  misc_feature: HIJSMM301BQ5XR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccagggaccgacacgtagaatagagacgaactagtggcgtgcaccatctgtcttctactcttcccgt

SEQ ID NO: 542213 - DNA, 509 bp, Homo sapiens
  misc_feature: HIJSMM301EOOFX.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccg

SEQ ID NO: 542214 - DNA, 485 bp, Homo sapiens
  misc_feature: HIJSMM301EMQOW.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccgagggacgaaggtcgaaatgagacgaactgtggctgcaccatctgtt

SEQ ID NO: 542215 - DNA, 512 bp, Homo sapiens
  misc_feature: HIJSMM301EQXCT.5.58.F03.1.454.light.4.raw
atcagacacgcacgaccggtgctcgatttagtctgatcgagaagggaaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 542216 - DNA, 485 bp, Homo sapiens; identical to SEQ ID NO: 536040
  misc_feature: HIJSMM301E3ICR.15.1.A01.1.454.light.4.raw

SEQ ID NO: 542217 - DNA, 494 bp, Homo sapiens
  misc_feature: HIJSMM301BS0E5.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggtttcgtcggagggaccaagctgaccgtcctaggtcagccaaggctgcccctcggt

SEQ ID NO: 542218 - DNA, 519 bp, Homo sapiens; identical to SEQ ID NO: 541911
  misc_feature: HIJSMM301C3LYB.27.23.C01.1.454.light.4.raw

SEQ ID NO: 542219 - DNA, 489 bp, Homo sapiens; identical to SEQ ID NO: 535139
  misc_feature: HIJSMM301ECLNO.14.55.E11.1.454.light.4.raw

SEQ ID NO: 542220 - DNA, 457 bp, Homo sapiens
  misc_feature: HIJSMM301BA0BI.22.28.C06.1.454.light.4.raw
acatacgcgtcacgaccggtgctcgatttagagctcacgtattgggtttggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccgggctgaccgtcctaggtcagcccaaggctgcccctcggtcactctgttcccacctcctcacgcgtatgt

SEQ ID NO: 542221 - DNA, 494 bp, Homo sapiens; identical to SEQ ID NO: 534992
  misc_feature: HIJSMM301BOCJ4.9.1.A01.1.454.light.4.raw

SEQ ID NO: 542222 - DNA, 505 bp, Homo sapiens; identical to SEQ ID NO: 535503
  misc_feature: HIJSMM301CDZ6L.8.28.C06.1.454.light.4.raw

SEQ ID NO: 542223 - DNA, 475 bp, Homo sapiens
  misc_feature: HIJSMM301AFTTU.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactagtggctgcacc

SEQ ID NO: 542224 - DNA, 503 bp, Homo sapiens; identical to SEQ ID NO: 538884
  misc_feature: HIJSMM301DE65K.27.78.H01.1.454.light.4.raw

SEQ ID NO: 542225 - DNA, 507 bp, Homo sapiens
  misc_feature: HIJSMM301BCNU6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaagtacaaacgaactagtggctgcaccatctgtcttctatcttccccg

SEQ ID NO: 542226 - DNA, 454 bp, Homo sapiens; identical to SEQ ID NO: 534964
  misc_feature: HIJSMM301B0SSX.19.86.H09.1.454.light.4.raw

SEQ ID NO: 542227 - DNA, 497 bp, Homo sapiens; identical to SEQ ID NO: 536376
  misc_feature: HIJSMM301AR9O5.22.9.A09.1.454.light.4.raw

SEQ ID NO: 542228 - DNA, 498 bp, Homo sapiens; identical to SEQ ID NO: 537020
  misc_feature: HIJSMM301CMLKO.26.26.C04.1.454.light.4.raw

SEQ ID NO: 542229 - DNA, 516 bp, Homo sapiens
  misc_feature: HIJSMM301DQYL6.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcact

SEQ ID NO: 542230 - DNA, 451 bp, Homo sapiens
  misc_feature: HIJSMM301C38HY.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccgcctcctccacgagagta

SEQ ID NO: 542231 - DNA, 503 bp, Homo sapiens
  misc_feature: HIJSMM301AZVEF.12.53.E09.1.454.light.4.raw
  modified_base (494)..(494): a, c, t, g, unknown or other
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtctattcggcggagggaccaagctgaccgtcctgggtcagcccaaggctgccccctcggtcactctgttcccaccctcctntactcgtat

SEQ ID NO: 542232 - DNA, 483 bp, Homo sapiens
  misc_feature: HIJSMM301B9XWO.48.19.B08.1.454.light.4.raw
agtatacatacacgaccggtgctcgatttagtgagtcagtaaggggtggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagccccg

SEQ ID NO: 542233 - DNA, 485 bp, Homo sapiens
  misc_feature: HIJSMM301EU42I.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctcgacgttcgccaaggaccgaagtggaactcaaacgaaa

SEQ ID NO: 542234 - DNA, 444 bp, Homo sapiens; identical to SEQ ID NO: 535594
  misc_feature: HIJSMM301DW62I.9.9.A09.1.454.light.4.raw

SEQ ID NO: 542235 - DNA, 485 bp, Homo sapiens; identical to SEQ ID NO: 536040
  misc_feature: HIJSMM301ALG19.15.1.A01.1.454.light.4.raw

SEQ ID NO: 542236 - DNA, 505 bp, Homo sapiens
  misc_feature: HIJSMM301B29W9.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcgggaggacccaaactgaccgtcctaggtcaggccccaa

SEQ ID NO: 542237 - DNA, 440 bp, Homo sapiens
  misc_feature: HIJSMM301CBEFC.41.9.A09.1.454.light.4.raw
tctatactatcacgaccggtgctcgatttagcgagacgcgcagggccctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 542238 - DNA, 486 bp, Homo sapiens; identical to SEQ ID NO: 536261
  misc_feature: HIJSMM301BA349.26.55.E11.1.454.light.4.raw

SEQ ID NO: 542239 - DNA, 505 bp, Homo sapiens; identical to SEQ ID NO: 535503
  misc_feature: HIJSMM301BLAGV.8.28.C06.1.454.light.4.raw

SEQ ID NO: 542240 - DNA, 500 bp, Homo sapiens
  misc_feature: HIJSMM301A0F7O.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctgggaacagagttcactctcaccatcagcggcctgcagtctgaagattttgctagtttattactgtcagcagtataatgacttgggttttattctactttcggccctcgggaaccaaagtggtatttcagacgaactgtggctgcaccatctgttcttcta

SEQ ID NO: 542241 - DNA, 517 bp, Homo sapiens
  misc_feature: HIJSMM301D756J.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcatcttccccg

SEQ ID NO: 542242 - DNA, 491 bp, Homo sapiens; identical to SEQ ID NO: 535294
  misc_feature: HIJSMM301A0MH0.16.68.G02.1.454.light.4.raw

SEQ ID NO: 542243 - DNA, 514 bp, Homo sapiens; identical to SEQ ID NO: 538885
  misc_feature: HIJSMM301CIZLV.14.19.B08.1.454.light.4.raw

SEQ ID NO: 542244 - DNA, 462 bp, Homo sapiens
  misc_feature: HIJSMM301CJGB3.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaa

SEQ ID NO: 542245 - DNA, 488 bp, Homo sapiens; identical to SEQ ID NO: 535990
  misc_feature: HIJSMM301AKUNZ.11.28.C06.1.454.light.4.raw

SEQ ID NO: 542246 - DNA, 492 bp, Homo sapiens; identical to SEQ ID NO: 538644
  misc_feature: HIJSMM301AIU1F.26.78.H01.1.454.light.4.raw

SEQ ID NO: 542247 - DNA, 500 bp, Homo sapiens
  misc_feature: HIJSMM301AZ6CN.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccaccctcctccacgagagta

SEQ ID NO: 542248 - DNA, 447 bp, Homo sapiens; identical to SEQ ID NO: 535020
  misc_feature: HIJSMM301CYJS7.18.9.A09.1.454.light.4.raw

SEQ ID NO: 542249 - DNA, 519 bp, Homo sapiens
  misc_feature: HIJSMM301CTCS6.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctagttcggcggaggaccaagctgaccgtcttaagtcacgcccaaggctcgccccctcggtcactctcgttccccaccctcctcc

SEQ ID NO: 542250 - DNA, 513 bp, Homo sapiens
  misc_feature: HIJSMM301BRILX.43.33.C11.1.454.light.4.raw
  modified_base (471)..(471): a, c, t, g, unknown or other
tgtgagtagtcacgaccggtgctcgatttagagtgagctcgttgggtttgggggaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctactaacttacgttcgaggacggaactaggtacaactntaactagtacctaagttgggtcggtctcgacccaactcttcg

SEQ ID NO: 542251 - DNA, 522 bp, Homo sapiens
  misc_feature: HIJSMM301AG504.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggggaccaggctgaccgtcctaggtcagcccaaggctgccccctcggtcactctgttcccgccct

SEQ ID NO: 542252 - DNA, 488 bp, Homo sapiens
  misc_feature: HIJSMM301BRYCP.43.33.C11.1.454.light.4.raw
  modified_base (436)..(436): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctanaatttcggtcaggggaccaagttgaacatcaatcgaactgtggctgcaccat

SEQ ID NO: 542253 - DNA, 503 bp, Homo sapiens
  misc_feature: HIJSMM301D8I2J.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgcccctcggtcactctgttcccaccctcctctacgtcgtat

SEQ ID NO: 542254 - DNA, 483 bp, Homo sapiens
  misc_feature: HIJSMM301DG1GO.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccc

SEQ ID NO: 542255 - DNA, 486 bp, Homo sapiens
  misc_feature: HIJSMM301BKOJ7.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggcccaagggaccaaggtggatatcagacgaa

SEQ ID NO: 542256 - DNA, 486 bp, Homo sapiens
  misc_feature: HIJSMM301CLNDR.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgcccccc

SEQ ID NO: 542257 - DNA, 463 bp, Homo sapiens; identical to SEQ ID NO: 535062
  misc_feature: HIJSMM301C56ID.11.73.G07.1.454.light.4.raw

SEQ ID NO: 542258 - DNA, 485 bp, Homo sapiens
  misc_feature: HIJSMM301ERCOJ.10.48.E04.1.454.light.4.raw
catagtagtgcacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagccaccctgtctttgtctccaggggaaggagccaccctctcctgcagggccagtcagagtgttagcatctacttagcctggttccaacagaaacctggccaggctcccaggctcctcatctataatgcatccaacagggccactggcatcccagccaggttcagtggcagtgggtctgggacagacttcactctcaccatcagcagcctagagcctgaagattttgcagtttattactgtcagcagcgtttcgcctggcctcacacttttggccaggggaccaagctggagatcatgcgaactgtggctgcacca

SEQ ID NO: 542259 - DNA, 512 bp, Homo sapiens; identical to SEQ ID NO: 538534
  misc_feature: HIJSMM301EQ44S.15.86.H09.1.454.light.4.raw

SEQ ID NO: 542260 - DNA, 505 bp, Homo sapiens; identical to SEQ ID NO: 535503
  misc_feature: HIJSMM301EJ1WR.8.28.C06.1.454.light.4.raw

SEQ ID NO: 542261 - DNA, 485 bp, Homo sapiens
  misc_feature: HIJSMM301EUVS2.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaa

SEQ ID NO: 542262 - DNA, 495 bp, Homo sapiens; identical to SEQ ID NO: 538269
  misc_feature: HIJSMM301CAIKS.9.1.A01.1.454.light.4.raw

SEQ ID NO: 542263 - DNA, 494 bp, Homo sapiens; identical to SEQ ID NO: 534992
  misc_feature: HIJSMM301C78FM.9.1.A01.1.454.light.4.raw

SEQ ID NO: 542264 - DNA, 494 bp, Homo sapiens
  misc_feature: HIJSMM301CJ7UL.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcaccatctgtctt

SEQ ID NO: 542265 - DNA, 503 bp, Homo sapiens
  misc_feature: HIJSMM301ALUM1.49.78.H01.1.454.light.4.raw
agtcgagagacacgaccggtgctcgatttagtgtgagtagtttgggtttgggggaatcagacccagtcaggacacagcatggacatgagagtcctcgctcagctcctggggctcctgctgctctgtttcccaggtgccagatgtgacatccagatgacccagtctccatcctcactgtctacatctctaacagacagagtcaccatcacttgtcgggcgagtcagggcgtttgagggcgttagtaattctttggactggtttcaccagaaaccagggaaagcccctaagtccatcatctatgttgcatcctgtttgcgaagaggggtcccatcagagttcagcggcagtggatcgacgctagcaggacaccagaaaatgaacctgaaaaggggagaataggattcaagcagcctttctcatatgcatggcttcaagagaggtttttgttggaggggaaagggtgacatccctcactgtggctcactttcggcggcggggacca

SEQ ID NO: 542266 - DNA, 509 bp, Homo sapiens
  misc_feature: HIJSMM301AZZ1T.7.71.G05.1.454.light.4.raw
cgtgtctctacacgaccggtgctcgatttagtgtcgtcgcaagagagaggggggaggaactgctcagttaggacccacgagggaaccatggaagccccacgctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaacgaaactgtggctgcaccatctgtctt

SEQ ID NO: 542267 - DNA, 491 bp, Homo sapiens
  misc_feature: HIJSMM301CK8BC.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggggtttactactgcatgcagggtacactctggccgttcacttttggccaggggaccaaactggatatcagacgaactgtggctgca

SEQ ID NO: 542268 - DNA, 485 bp, Homo sapiens; identical to SEQ ID NO: 534977
  misc_feature: HIJSMM301CHKP7.15.28.C06.1.454.light.4.raw

SEQ ID NO: 542269 - DNA, 475 bp, Homo sapiens; identical to SEQ ID NO: 537714
  misc_feature: HIJSMM301ET75D.7.81.H04.1.454.light.4.raw

SEQ ID NO: 542270 - DNA, 479 bp, Homo sapiens
  misc_feature: HIJSMM301B2MFV.52.75.G09.1.454.light.4.raw
  modified_base (434)..(434): a, c, t, g, unknown or other
cgcagtacgacacgaccggtgctcgatttagtatagacatcaacaccaaaggggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctggggacagattttactttcaccatcagcaggctgcagcctgaagacattgcaacatattactgtcaacagtatgatagtctccgctnactttcggcgggggaccgaagtggagatcaagcgactagtggtcg

SEQ ID NO: 542271 - DNA, 500 bp, Homo sapiens
  misc_feature: HIJSMM301APCI0.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccaccctcctccacgagagta

SEQ ID NO: 542272 - DNA, 501 bp, Homo sapiens
  misc_feature: HIJSMM301BECTF.15.56.F01.1.454.light.4.raw
  modified_base (483)..(483): a, c, t, g, unknown or other
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttcccnccctcctcgctacgtaga

SEQ ID NO: 542273 - DNA, 494 bp, Homo sapiens
  misc_feature: HIJSMM301ECCNF.51.81.H04.1.454.light.4.raw
cgatcgtatacacgaccggtgctcgatttagtagtgtagattcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaaccccactgtcactctcg

SEQ ID NO: 542274 - DNA, 485 bp, Homo sapiens
  misc_feature: HIJSMM301A0O42.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccgaaggtggagatcaaacgaactagtggctgcacc

SEQ ID NO: 542275 - DNA, 488 bp, Homo sapiens; identical to SEQ ID NO: 535990
  misc_feature: HIJSMM301C21FZ.11.28.C06.1.454.light.4.raw

SEQ ID NO: 542276 - DNA, 520 bp, Homo sapiens; identical to SEQ ID NO: 539176
  misc_feature: HIJSMM301DTLH0.27.23.C01.1.454.light.4.raw

SEQ ID NO: 542277 - DNA, 490 bp, Homo sapiens; identical to SEQ ID NO: 535526
  misc_feature: HIJSMM301DVIOR.26.78.H01.1.454.light.4.raw

SEQ ID NO: 542278 - DNA, 509 bp, Homo sapiens; identical to SEQ ID NO: 536784
  misc_feature: HIJSMM301AI3KW.47.55.E11.1.454.light.4.raw

SEQ ID NO: 542279 - DNA, 514 bp, Homo sapiens
  misc_feature: HIJSMM301AO7TM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccgaacggaccgaaggtaggaaagtacaaacgaaactagtggcgtgcaccactctgtcttctatcttccccg

SEQ ID NO: 542280 - DNA, 489 bp, Homo sapiens
  misc_feature: HIJSMM301D3HPR.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaaatcaaacgaactagtggctgcaccat

SEQ ID NO: 542281 - DNA, 489 bp, Homo sapiens
  misc_feature: HIJSMM301DMRY2.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttattctgtctgcagtacaatcagtggcctcggacgttcggccaagggaccaaggtggaaatacaaacgaactgtggctgcaccatctgtcttcta

SEQ ID NO: 542282 - DNA, 501 bp, Homo sapiens; identical to SEQ ID NO: 535873
  misc_feature: HIJSMM301EPECE.17.27.C05.1.454.light.4.raw

SEQ ID NO: 542283 - DNA, 494 bp, Homo sapiens; identical to SEQ ID NO: 534992
  misc_feature: HIJSMM301AMMZQ.9.1.A01.1.454.light.4.raw

SEQ ID NO: 542284 - DNA, 377 bp, Homo sapiens; identical to SEQ ID NO: 536071
  misc_feature: HIJSMM301C04EN.40.9.A09.1.454.light.4.raw

SEQ ID NO: 542285 - DNA, 512 bp, Homo sapiens; identical to SEQ ID NO: 536939
  misc_feature: HIJSMM301AQ1JK.15.76.G10.1.454.light.4.raw

SEQ ID NO: 542286 - DNA, 484 bp, Homo sapiens
  misc_feature: HIJSMM301EMKOS.52.59.F04.1.454.light.4.raw
cgcagtacgacacgaccggtgctcgatttagtacacacacttagggattgggtgacttcgcaggcgtagactttgtgtttctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagccctaaactcctgatctacgatgcatccaatttggagacaggggtcccatcaaggttcactggaagtggatctgggacacattttacttcaccatcagcggcctgcagcctgaagattttgcaacatattactgtcaacaatatgaagatctccccctcactttcggcggaggaccaaggtggagatcagacgaactgtggctgcaccatctgtcttcatcttccgccatctgatatacgatcg

SEQ ID NO: 542287 - DNA, 491 bp, Homo sapiens
  misc_feature: HIJSMM301DJ9ES.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggaccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 542288 - DNA, 504 bp, Homo sapiens
  misc_feature: HIJSMM301BWB0P.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccgcc

SEQ ID NO: 542289 - DNA, 517 bp, Homo sapiens
  misc_feature: HIJSMM301AD2BB.14.70.G04.1.454.light.4.raw
  modified_base (505)..(505): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaaccccnctgtcactctcg

SEQ ID NO: 542290 - DNA, 417 bp, Homo sapiens
  misc_feature: HIJSMM301AZQL0.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccgggctgaggacgaggctgattattactgcagctcatatacaagcagcagcactcaagtcttcggaactgggaccaaggtcaccgtcctaggtcagcccaaggccaaccccactgtcactctgttcccgccctcctccactactcgta

SEQ ID NO: 542291 - DNA, 481 bp, Homo sapiens
  misc_feature: HIJSMM301BC8VN.48.35.D02.1.454.light.4.raw
agtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 542292 - DNA, 487 bp, Homo sapiens; identical to SEQ ID NO: 536206
  misc_feature: HIJSMM301EPAEI.47.38.D05.1.454.light.4.raw

SEQ ID NO: 542293 - DNA, 486 bp, Homo sapiens
  misc_feature: HIJSMM301AYUXN.41.10.A10.1.454.light.4.raw
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaatcaaacgaactgtggctgcaccatctgtcttcat

SEQ ID NO: 542294 - DNA, 440 bp, Homo sapiens
  misc_feature: HIJSMM301AOM7W.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatctccg

SEQ ID NO: 542295 - DNA, 493 bp, Homo sapiens
  misc_feature: HIJSMM301DFXKB.53.5.A05.1.454.light.4.raw
cgcgtatacacacgaccggtgctcgatttagatagatagacagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactc

SEQ ID NO: 542296 - DNA, 489 bp, Homo sapiens
  misc_feature: HIJSMM301A3CIB.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccagggaccaaactggatatcagacgaactgtggctgca

SEQ ID NO: 542297 - DNA, 493 bp, Homo sapiens
  misc_feature: HIJSMM301EAO1G.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaactgtggcg

SEQ ID NO: 542298 - DNA, 505 bp, Homo sapiens
  misc_feature: HIJSMM301DR1NW.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcactctcg

SEQ ID NO: 542299 - DNA, 495 bp, Homo sapiens
  misc_feature: HIJSMM301BERIO.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgcctcct

SEQ ID NO: 542300 - DNA, 496 bp, Homo sapiens
  misc_feature: HIJSMM301AONT8.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtattttacactgaaaatcaacagagtggaggctgaggatggttggggtttattactgcatgcaagctctacaaactccctcaacgttcggcggagggaccaaggtggagatacaaacgaactgtggctgcaccatctgtcttcta

SEQ ID NO: 542301 - DNA, 456 bp, Homo sapiens
  misc_feature: HIJSMM301BC43U.49.85.H08.1.454.light.4.raw
agtcgagagacacgaccggtgctcgatttagtatcactcagtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagtgggactcaggctatcgatgaggctgactattactgtcaggcgtgggacagccgcactggggtattcggcggagggaccaagctgaccgt

SEQ ID NO: 542302 - DNA, 488 bp, Homo sapiens; identical to SEQ ID NO: 535568
  misc_feature: HIJSMM301AYLY9.21.4.A04.1.454.light.4.raw

SEQ ID NO: 542303 - DNA, 494 bp, Homo sapiens; identical to SEQ ID NO: 534992
  misc_feature: HIJSMM301A1O24.9.1.A01.1.454.light.4.raw

SEQ ID NO: 542304 - DNA, 505 bp, Homo sapiens; identical to SEQ ID NO: 535987
  misc_feature: HIJSMM301DJICW.18.37.D04.1.454.light.4.raw

SEQ ID NO: 542305 - DNA, 486 bp, Homo sapiens
  misc_feature: HIJSMM301BESQA.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccg

SEQ ID NO: 542306 - DNA, 478 bp, Homo sapiens; identical to SEQ ID NO: 535129
  misc_feature: HIJSMM301CGGT0.11.11.A11.1.454.light.4.raw

SEQ ID NO: 542307 - DNA, 460 bp, Homo sapiens; identical to SEQ ID NO: 536053
  misc_feature: HIJSMM301BWZBX.22.28.C06.1.454.light.4.raw

SEQ ID NO: 542308 - DNA, 491 bp, Homo sapiens
  misc_feature: HIJSMM301DQCMO.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgcctgaggacgaggctcattattactgcagctcatatacacccaggggcactctcgtgatattcggcggagggacctggctgaccgtcctacgtcagcccaac

SEQ ID NO: 542309 - DNA, 500 bp, Homo sapiens
  misc_feature: HIJSMM301A1B6P.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 542310 - DNA, 491 bp, Homo sapiens
  misc_feature: HIJSMM301CH9UY.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcatt

SEQ ID NO: 542311 - DNA, 482 bp, Homo sapiens
  misc_feature: HIJSMM301EDEDT.49.73.G07.1.454.light.4.raw
agtcgagagacacgaccggtgctcgatttagctctacgctcagggcacgaccggtgctcgatttagagctcacgtattgggtttggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctgcaagcaggtccaatattgcgaatgagtatgtttcctggtaccagcacctcccaggaacagtccccaaactcctcatttatgacaataataggcgaccctcagggattcctgaccgattctctggctccaagtctgccgcgtcagccaccctgggcatcaccggactccagactggggacagggcgattattactgcgcaataggggatagaagt

SEQ ID NO: 542312 - DNA, 505 bp, Homo sapiens
  misc_feature: HIJSMM301DC0DM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccagggaccaaggtggaaagtacaaacgaactagtggcgtgcaccatctgtcttcatcttccccg

SEQ ID NO: 542313 - DNA, 489 bp, Homo sapiens
  misc_feature: HIJSMM301A9Z59.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactagaaaatcagccgggtggggctgaggatgttggcatttattactgcatgcaggctatacaccttcctgcctacttttggccaggggaccaagctggagatcaggcgaacg

SEQ ID NO: 542314 - DNA, 494 bp, Homo sapiens
  misc_feature: HIJSMM301ADHIB.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcattttcccgt

SEQ ID NO: 542315 - DNA, 505 bp, Homo sapiens; identical to SEQ ID NO: 536254
  misc_feature: HIJSMM301DPXX1.7.71.G05.1.454.light.4.raw

SEQ ID NO: 542316 - DNA, 352 bp, Homo sapiens
  misc_feature: HIJSMM301DARGZ.4.67.G01.1.454.light.4.raw
agcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaaccccactgtcactctgttcccaccctcctcctacagtgct

SEQ ID NO: 542317 - DNA, 514 bp, Homo sapiens
  misc_feature: HIJSMM301A1QU9.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgccctcctc

SEQ ID NO: 542318 - DNA, 483 bp, Homo sapiens
  misc_feature: HIJSMM301DZXS6.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaacgaactgtggctgca

SEQ ID NO: 542319 - DNA, 496 bp, Homo sapiens
  misc_feature: HIJSMM301AM6KQ.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagacgaaactgtggctgcaccatctgtcttcatcttcccg

SEQ ID NO: 542320 - DNA, 470 bp, Homo sapiens
  misc_feature: HIJSMM301BFM3A.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccacgggagtcaaagtaggatgtcaaccgaac

SEQ ID NO: 542321 - DNA, 492 bp, Homo sapiens
  misc_feature: HIJSMM301DYM42.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcgagggaccaaggtggagatcaaacgaactgtggctgcaccatctgtcttta

SEQ ID NO: 542322 - DNA, 478 bp, Homo sapiens
  misc_feature: HIJSMM301B8O9J.52.1.A01.1.454.light.4.raw
cgcagtacgacacgaccggtgctcgatttagacgtctcatcaggggcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcacctttcggccctgggaccatagtggatatcaaacgaactgtggctgcaccatctgtctt

SEQ ID NO: 542323 - DNA, 491 bp, Homo sapiens
  misc_feature: HIJSMM301CVI8N.48.55.E11.1.454.light.4.raw
agtatacatacacgaccggtgctcgatttagcactcgcacgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 542324 - DNA, 480 bp, Homo sapiens; identical to SEQ ID NO: 535291
  misc_feature: HIJSMM301CCSKV.22.59.F04.1.454.light.4.raw

SEQ ID NO: 542325 - DNA, 502 bp, Homo sapiens
  misc_feature: HIJSMM301DX0M8.48.60.F05.1.454.light.4.raw
agtatacatacacgaccggtgctcgatttagtacgtcatcagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcacca

SEQ ID NO: 542326 - DNA, 494 bp, Homo sapiens
  misc_feature: HIJSMM301CU60K.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgttctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 542327 - DNA, 486 bp, Homo sapiens
  misc_feature: HIJSMM301EC7PJ.10.25.C03.1.454.light.4.raw
catagtagtgcacgaccggtgctcgatttagtagtgtagatttgggtttggggcagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagattttgcagtttattactgtcaggaatatgatggctggcctccgtacacttttggccaagggaccaagttggacatcaaacgaa

SEQ ID NO: 542328 - DNA, 470 bp, Homo sapiens
  misc_feature: HIJSMM301AT853.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctcctccgagtgccacttttggcgggggaccaaggtggacatcaaacgaa

SEQ ID NO: 542329 - DNA, 463 bp, Homo sapiens; identical to SEQ ID NO: 535062
  misc_feature: HIJSMM301CGPQS.11.73.G07.1.454.light.4.raw

SEQ ID NO: 542330 - DNA, 517 bp, Homo sapiens
  misc_feature: HIJSMM301BLV5L.9.12.B01.1.454.light.4.raw
  modified_base (424)..(424): a, c, t, g, unknown or other
tgatacgtctcacgaccggtgctcgatttagtagtgtagattccgcgggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttctcgggcgttcggccgaagggaccaaggtaggaaagtacaaacgaactagttaggcgtggcaccactctgttcttctattcttccccg

SEQ ID NO: 542331 - DNA, 496 bp, Homo sapiens; identical to SEQ ID NO: 537225
  misc_feature: HIJSMM301BSMWG.11.59.F04.1.454.light.4.raw

SEQ ID NO: 542332 - DNA, 494 bp, Homo sapiens
  misc_feature: HIJSMM301DWF9N.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtgggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcatt

SEQ ID NO: 542333 - DNA, 521 bp, Homo sapiens
  misc_feature: HIJSMM301AVYR0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaaggtacaaacgaaactagtaggcgtgcaccactctgtcttctatcttcccgtcccactctcg

SEQ ID NO: 542334 - DNA, 497 bp, Homo sapiens; identical to SEQ ID NO: 535664
  misc_feature: HIJSMM301B1SOF.22.14.B03.1.454.light.4.raw

SEQ ID NO: 542335 - DNA, 486 bp, Homo sapiens; identical to SEQ ID NO: 535290
  misc_feature: HIJSMM301CJVD9.3.12.B01.1.454.light.4.raw

SEQ ID NO: 542336 - DNA, 503 bp, Homo sapiens; identical to SEQ ID NO: 537189
  misc_feature: HIJSMM301BV9C3.19.85.H08.1.454.light.4.raw

SEQ ID NO: 542337 - DNA, 484 bp, Homo sapiens
  misc_feature: HIJSMM301A5AA1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattatatacttcgtggacgttggccaaggaccgaaggtggatatcagacgaa

SEQ ID NO: 542338 - DNA, 504 bp, Homo sapiens; identical to SEQ ID NO: 542288
  misc_feature: HIJSMM301AI59O.8.28.C06.1.454.light.4.raw

SEQ ID NO: 542339 - DNA, 484 bp, Homo sapiens
  misc_feature: HIJSMM301AOJ8K.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtccaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactagtggctgcaccat

SEQ ID NO: 542340 - DNA, 485 bp, Homo sapiens; identical to SEQ ID NO: 535501
  misc_feature: HIJSMM301AR8VX.3.10.A10.1.454.light.4.raw

SEQ ID NO: 542341 - DNA, 498 bp, Homo sapiens
  misc_feature: HIJSMM301ES5P4.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactagtggctgcaccatctgtt

SEQ ID NO: 542342 - DNA, 498 bp, Homo sapiens
  misc_feature: HIJSMM301AS7UB.12.27.C05.1.454.light.4.raw
atacgacgtacacgaccggtgctcgatttagacgcgatcgaagggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtca

SEQ ID NO: 542343 - DNA, 485 bp, Homo sapiens; identical to SEQ ID NO: 536630
  misc_feature: HIJSMM301CF5YM.13.56.F01.1.454.light.4.raw

SEQ ID NO: 542344 - DNA, 516 bp, Homo sapiens
  misc_feature: HIJSMM301CDSVJ.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaggtggcaatcaaccgaactgtggctgcaccatctgtcttcatcttccccg

SEQ ID NO: 542345 - DNA, 492 bp, Homo sapiens; identical to SEQ ID NO: 534967
  misc_feature: HIJSMM301DKILV.47.64.F09.1.454.light.4.raw

SEQ ID NO: 542346 - DNA, 482 bp, Homo sapiens
  misc_feature: HIJSMM301C8RWM.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaacgaa

SEQ ID NO: 542347 - DNA, 489 bp, Homo sapiens; identical to SEQ ID NO: 535139
  misc_feature: HIJSMM301DO4WH.14.55.E11.1.454.light.4.raw

SEQ ID NO: 542348 - DNA, 490 bp, Homo sapiens
  misc_feature: HIJSMM301BWAUX.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggtcaagggacacgactggagattaaacgaa

SEQ ID NO: 542349 - DNA, 501 bp, Homo sapiens
  misc_feature: HIJSMM301EO7TI.51.14.B03.1.454.light.4.raw
cgatcgtatacacgaccggtgctcgatttagtgtgagtagttccgcggggaggagtcagaccccgtcgggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctctcactttcggcggagggaccaaggtagaaaccaaacgaactgtggctgcaccatctgtcttcatcttccccg

SEQ ID NO: 542350 - DNA, 487 bp, Homo sapiens
  misc_feature: HIJSMM301B9ANW.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccagggaccgaaggtggaaatacaacgaactgtggctgcacca

SEQ ID NO: 542351 - DNA, 504 bp, Homo sapiens
  misc_feature: HIJSMM301EPCL3.43.33.C11.1.454.light.4.raw
  modified_base (491)..(491): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaacttcggttcgagggaccggaacttagtacaatcaatacgtacgtagtggctcncgaccactcttcg

SEQ ID NO: 542352 - DNA, 486 bp, Homo sapiens; identical to SEQ ID NO: 535458
  misc_feature: HIJSMM301C87PB.7.75.G09.1.454.light.4.raw

SEQ ID NO: 542353 - DNA, 473 bp, Homo sapiens; identical to SEQ ID NO: 535262
  misc_feature: HIJSMM301BJT28.8.67.G01.1.454.light.4.raw

SEQ ID NO: 542354 - DNA, 514 bp, Homo sapiens
  misc_feature: HIJSMM301DWDEL.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacggaccgaacggtaggaaagtacaagacgaactacgtggctgcaccactctgtcttctatcttcccgt

SEQ ID NO: 542355 - DNA, 490 bp, Homo sapiens; identical to SEQ ID NO: 535526
  misc_feature: HIJSMM301AGC9S.26.78.H01.1.454.light.4.raw

SEQ ID NO: 542356 - DNA, 498 bp, Homo sapiens
  misc_feature: HIJSMM301BGL08.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactggagattaaacgaacgtgtggcgtgtcaccactctgtcttt

SEQ ID NO: 542357 - DNA, 493 bp, Homo sapiens
  misc_feature: HIJSMM301BO2TO.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtcaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 542358 - DNA, 501 bp, Homo sapiens
  misc_feature: HIJSMM301D4402.48.30.C08.1.454.light.4.raw
agtatacatacacgaccggtgctcgatttagtctgacgtcaaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccgccc

SEQ ID NO: 542359 - DNA, 478 bp, Homo sapiens
  misc_feature: HIJSMM301D5P1L.49.30.C08.1.454.light.4.raw
agtcgagagacacgaccggtgctcgatttagtctgacgtcaaagggaaaggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcgggggaccgaaggtggagagtcaagcgaactgtggctg

SEQ ID NO: 542360 - DNA, 454 bp, Homo sapiens
  misc_feature: HIJSMM301C7DQ1.19.86.H09.1.454.light.4.raw
tactctcgtgcacgaccggtgctcgatttagtgctatagacttgggtttgggggccgttcctgggcccagtctgtgctgactcaggaaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 542361 - DNA, 518 bp, Homo sapiens
  misc_feature: HIJSMM301B9CS0.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctggccccctcggtcactctgttcccacctcctcacg

SEQ ID NO: 542362 - DNA, 498 bp, Homo sapiens; identical to SEQ ID NO: 536879
  misc_feature: HIJSMM301BVOP7.22.14.B03.1.454.light.4.raw

SEQ ID NO: 542363 - DNA, 502 bp, Homo sapiens
  misc_feature: HIJSMM301EAJ7K.48.57.F02.1.454.light.4.raw
agtatacatacacgaccggtgctcgatttagctcgatatagttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagcgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaacgaactgtgctgcaccatctgtcttcatcttcccgc

SEQ ID NO: 542364 - DNA, 501 bp, Homo sapiens
  misc_feature: HIJSMM301C1CLR.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatct

SEQ ID NO: 542365 - DNA, 404 bp, Homo sapiens; identical to SEQ ID NO: 535530
  misc_feature: HIJSMM301BZ87N.4.35.D02.1.454.light.4.raw

SEQ ID NO: 542366 - DNA, 486 bp, Homo sapiens
  misc_feature: HIJSMM301A0YE0.43.61.F06.1.454.light.4.raw
tgtgagtagtcacgaccggtgctcgatttagctacgctctaagggaaaggggaagagctgctcagttaggacccagagggaaccatggaaaccccagcgcagcttctcttcctcctgctactctggctcccagatgccaccggagcaattgtgttgacgcagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagattttgcagtgtattactgtcagcagtatggtagctcacaggggacgttcgggccaagggaccaaggtggaaatcaaacgaactgtggctgcacc

SEQ ID NO: 542367 - DNA, 493 bp, Homo sapiens
  misc_feature: HIJSMM301A1DBQ.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccggcgagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgccgtcttaggtcagcccaaggct

SEQ ID NO: 542368 - DNA, 496 bp, Homo sapiens; identical to SEQ ID NO: 535109
  misc_feature: HIJSMM301AFSBP.16.78.H01.1.454.light.4.raw

SEQ ID NO: 542369 - DNA, 496 bp, Homo sapiens; identical to SEQ ID NO: 535541
  misc_feature: HIJSMM301A770Y.3.33.C11.1.454.light.4.raw

SEQ ID NO: 542370 - DNA, 494 bp, Homo sapiens; identical to SEQ ID NO: 534992
  misc_feature: HIJSMM301AGTO0.9.1.A01.1.454.light.4.raw

SEQ ID NO: 542371 - DNA, 444 bp, Homo sapiens; identical to SEQ ID NO: 535192
  misc_feature: HIJSMM301AYYJ7.5.9.A09.1.454.light.4.raw

SEQ ID NO: 542372 - DNA, 502 bp, Homo sapiens
  misc_feature: HIJSMM301BWZYB.48.55.E11.1.454.light.4.raw
agtatacatacacgaccggtgctcgatttagcactcgcacgttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccccg

SEQ ID NO: 542373 - DNA, 479 bp, Homo sapiens; identical to SEQ ID NO: 538892
  misc_feature: HIJSMM301CHHJB.22.59.F04.1.454.light.4.raw

SEQ ID NO: 542374 - DNA, 490 bp, Homo sapiens
  misc_feature: HIJSMM301BRW6F.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggcgtgaggatgttggcgatttattactgcatgcaggctatacaccttcctgccacttttggtccaggggaccaagctggagatcaggcgaacg

SEQ ID NO: 542375 - DNA, 496 bp, Homo sapiens
  misc_feature: HIJSMM301AS6L5.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactagtggctgcaccatctgtcttcatt

SEQ ID NO: 542376 - DNA, 490 bp, Homo sapiens; identical to SEQ ID NO: 535420
  misc_feature: HIJSMM301A0ILU.3.72.G06.1.454.light.4.raw

SEQ ID NO: 542377 - DNA, 491 bp, Homo sapiens
  misc_feature: HIJSMM301CPG1I.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagatttgcagttattactgtcagcagtatgatacctggcctccgtacacttttggccggggtaccaagctggaaatcaagcgaactgtggctgcaccatctgtcttcatt

SEQ ID NO: 542378 - DNA, 454 bp, Homo sapiens; identical to SEQ ID NO: 536943
  misc_feature: HIJSMM301DXZ61.19.86.H09.1.454.light.4.raw

SEQ ID NO: 542379 - DNA, 499 bp, Homo sapiens; identical to SEQ ID NO: 535899
  misc_feature: HIJSMM301DP0JB.19.78.H01.1.454.light.4.raw

SEQ ID NO: 542380 - DNA, 489 bp, Homo sapiens; identical to SEQ ID NO: 536663
  misc_feature: HIJSMM301B5GMV.16.72.G06.1.454.light.4.raw

SEQ ID NO: 542381 - DNA, 492 bp, Homo sapiens; identical to SEQ ID NO: 536087
  misc_feature: HIJSMM301D6YII.10.17.B06.1.454.light.4.raw

SEQ ID NO: 542382 - DNA, 490 bp, Homo sapiens
  misc_feature: HIJSMM301C9Q75.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcacttattactgtcagcagcgtagcaactggcctctcactttcggcggagggaccagggtggagatcagacgaactgtggctgcaccatctgtt

SEQ ID NO: 542383 - DNA, 502 bp, Homo sapiens
  misc_feature: HIJSMM301DC7PO.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctactacttttggccaggggaccaagctggagatcaaacgaactgtggctgcaccta

SEQ ID NO: 542384 - DNA, 498 bp, Homo sapiens
  misc_feature: HIJSMM301AK3HL.13.64.F09.1.454.light.4.raw
tcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctatttgaattggtatcagcaaacaccagggaaagcccccaaactcctgatcttcggttcatctcgtttgcaaagtggagtcccttcacggttcagtggcagtggatctgggacagacttcactctcaccatcggcagtcttcaacgtgacgactttgcaacgtactactgtcaacagacctacagtacacctcacagttttggccaggggaccaaggtggaagtcaagggaactgtggctgcaccatctgtcttcatcttcccgccat

SEQ ID NO: 542385 - DNA, 514 bp, Homo sapiens
  misc_feature: HIJSMM301AP9ZM.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgcccccctcggtcactctgttcccaccctcct

SEQ ID NO: 542386 - DNA, 502 bp, Homo sapiens
  misc_feature: HIJSMM301CD8R5.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctcgccccctc

SEQ ID NO: 542387 - DNA, 497 bp, Homo sapiens
  misc_feature: HIJSMM301ESACD.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccgaagggaccgaaggtggaagtcgaaacgaactagtggctgcaccactctgtctt

SEQ ID NO: 542388 - DNA, 503 bp, Homo sapiens
  misc_feature: HIJSMM301BZEAP.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactgtggctgcaccatctgtt

SEQ ID NO: 542389 - DNA, 512 bp, Homo sapiens
  misc_feature: HIJSMM301ER6WM.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggcccaaccccactgtcactcttcg

SEQ ID NO: 542390 - DNA, 503 bp, Homo sapiens
  misc_feature: HIJSMM301BOPH1.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgtt

SEQ ID NO: 542391 - DNA, 513 bp, Homo sapiens
  misc_feature: HIJSMM301DYTY9.49.71.G05.1.454.light.4.raw
agtcgagagacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctctttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaaggccaaccccactgtcactctgttcccgccctcct

SEQ ID NO: 542392 - DNA, 505 bp, Homo sapiens; identical to SEQ ID NO: 536254
  misc_feature: HIJSMM301CYVJ0.7.71.G05.1.454.light.4.raw

SEQ ID NO: 542393 - DNA, 439 bp, Homo sapiens
  misc_feature: HIJSMM301EDWB9.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctct

SEQ ID NO: 542394 - DNA, 501 bp, Homo sapiens
  misc_feature: HIJSMM301C0A6Z.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttcccg

SEQ ID NO: 542395 - DNA, 510 bp, Homo sapiens
  misc_feature: HIJSMM301AV17P.16.46.E02.1.454.light.4.raw
  modified_base (414)..(414): a, c, t, g, unknown or other
tgtactactccacgaccggtgctcgatttagactcatctacagggaaagggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattacngcagcttatatacaggcaacaatacttttgtcttcggaactgggaccaaggtcaccgtcctaggtcagcccaaggccaaccccactgtcactctcg

SEQ ID NO: 542396 - DNA, 490 bp, Homo sapiens
  misc_feature: HIJSMM301B670G.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactgt

SEQ ID NO: 542397 - DNA, 512 bp, Homo sapiens
  misc_feature: HIJSMM301A2DCP.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcatcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcgggagggaccgaagcctggacccgtccgtgggtcgacgcccaacggctcgccccctcggt

SEQ ID NO: 542398 - DNA, 505 bp, Homo sapiens
  misc_feature: HIJSMM301AN2KY.48.62.F07.1.454.light.4.raw
agtatacatacacgaccggtgctcgatttagtagtcgcataaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtggaaatcaaacgaactgtggctgcaccatctgt

SEQ ID NO: 542399 - DNA, 400 bp, Homo sapiens
  misc_feature: HIJSMM301D0KNM.8.53.E09.1.454.light.4.raw
ctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgcgag

SEQ ID NO: 542400 - DNA, 508 bp, Homo sapiens
  misc_feature: HIJSMM301BRE0U.17.33.C11.1.454.light.4.raw
  modified_base (501)..(501): a, c, t, g, unknown or other
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactcngttccca

SEQ ID NO: 542401 - DNA, 497 bp, Homo sapiens; identical to SEQ ID NO: 539058
  misc_feature: HIJSMM301B865P.12.87.H10.1.454.light.4.raw

SEQ ID NO: 542402 - DNA, 463 bp, Homo sapiens; identical to SEQ ID NO: 535062
  misc_feature: HIJSMM301EX8P2.11.73.G07.1.454.light.4.raw

SEQ ID NO: 542403 - DNA, 487 bp, Homo sapiens; identical to SEQ ID NO: 536536
  misc_feature: HIJSMM301B4ZBA.26.45.E01.1.454.light.4.raw

SEQ ID NO: 542404 - DNA, 489 bp, Homo sapiens
  misc_feature: HIJSMM301ECLKE.48.27.C05.1.454.light.4.raw
agtatacatacacgaccggtgctcgatttagacgcgatcgaagggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcgagggaccaagctgacagtcctaggtcagcccaaggctgccccctc

SEQ ID NO: 542405 - DNA, 488 bp, Homo sapiens
  misc_feature: HIJSMM301CMBN0.49.73.G07.1.454.light.4.raw
agtcgagagacacgaccggtgctcgatttagctctacgctcagggcacgaccggtgctcgatttagtcacgcgagaaagggaaaggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttgagatggtatcaacagaaaccagggaaagcccctaaactcctgatctatgctacattcgttttacaaagtgggtcccatcaaggttcagtggcagtggatctgggacagatttcactctcaccatcagcagtctgcaacctgaagattttgcaacttactactgtcaacagagttacagtaccccattcactttcggccctgggaccaaagtgga

SEQ ID NO: 542406 - DNA, 497 bp, Homo sapiens
  misc_feature: HIJSMM301BGNAV.9.53.E09.1.454.light.4.raw
tgatacgtctcacgaccggtgctcgatttagagagagtgtgtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctc

SEQ ID NO: 542407 - DNA, 512 bp, Homo sapiens
  misc_feature: HIJSMM301AVDS9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaacgggaccgaacggtggaaagtcaaacgaactagtggcgtgcaccactctgtcttctatcttccccg

SEQ ID NO: 542408 - DNA, 514 bp, Homo sapiens; identical to SEQ ID NO: 538153
  misc_feature: HIJSMM301D5QXK.17.37.D04.1.454.light.4.raw

SEQ ID NO: 542409 - DNA, 491 bp, Homo sapiens; identical to SEQ ID NO: 536211
  misc_feature: HIJSMM301A9I4F.16.53.E09.1.454.light.4.raw

SEQ ID NO: 542410 - DNA, 495 bp, Homo sapiens
  misc_feature: HIJSMM301AYR6N.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcaaccgaactgtggctgcaccatctgtt

SEQ ID NO: 542411 - DNA, 504 bp, Homo sapiens
  misc_feature: HIJSMM301BW8S5.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 542412 - DNA, 463 bp, Homo sapiens; identical to SEQ ID NO: 535008
  misc_feature: HIJSMM301EDS7B.10.9.A09.1.454.light.4.raw

SEQ ID NO: 542413 - DNA, 506 bp, Homo sapiens
  misc_feature: HIJSMM301BD4UH.52.27.C05.1.454.light.4.raw
cgcagtacgacacgaccggtgctcgatttagacgcgatcgaagggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 542414 - DNA, 484 bp, Homo sapiens
  misc_feature: HIJSMM301CVF8B.13.87.H10.1.454.light.4.raw
tcacgtactacacgaccggtgctcgatttagcagtactgcgttgggtttgggagtcagtcccagtcaggacacagcatggacatgagggtcccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgt

SEQ ID NO: 542415 - DNA, 490 bp, Homo sapiens
  misc_feature: HIJSMM301ES075.19.71.G05.1.454.light.4.raw
tactctcgtgcacgaccggtgctcgatttagtgtcgtcgcaagagagagggggaggtacaacaggcaggcaggggcgagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcgccaggacaagtggatatcagacgaactagtggctg

SEQ ID NO: 542416 - DNA, 495 bp, Homo sapiens
  misc_feature: HIJSMM301ED8GF.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaacgaactgtggctgcaccatctgtctt

SEQ ID NO: 542417 - DNA, 444 bp, Homo sapiens; identical to SEQ ID NO: 534993
  misc_feature: HIJSMM301DT3IN.5.9.A09.1.454.light.4.raw

SEQ ID NO: 542418 - DNA, 496 bp, Homo sapiens; identical to SEQ ID NO: 535109
  misc_feature: HIJSMM301C4GB0.16.78.H01.1.454.light.4.raw

SEQ ID NO: 542419 - DNA, 497 bp, Homo sapiens
  misc_feature: HIJSMM301BXVIN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgaactgtggctgcaccta

SEQ ID NO: 542420 - DNA, 472 bp, Homo sapiens; identical to SEQ ID NO: 540638
  misc_feature: HIJSMM301AUGJC.8.67.G01.1.454.light.4.raw

SEQ ID NO: 542421 - DNA, 502 bp, Homo sapiens; identical to SEQ ID NO: 537298
  misc_feature: HIJSMM301BVJX3.27.78.H01.1.454.light.4.raw

SEQ ID NO: 542422 - DNA, 512 bp, Homo sapiens
  misc_feature: HIJSMM301AJ98J.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcattttgtacaataataagcgaccctcagggattcctgaccgattctctggctccaagtctggcacgtcagccaccctgggcatcaccggactccagactggggacgaggccgattattactgcggaacatgggatagcagctcgagtactgtgataatcggcggagggaccaagctgaccgtcctaggtcagcccaaggctgccccctcggtcactctgttcccta

SEQ ID NO: 542423 - DNA, 521 bp, Homo sapiens; identical to SEQ ID NO: 538715
  misc_feature: HIJSMM301BNDHJ.27.23.C01.1.454.light.4.raw

SEQ ID NO: 542424 - DNA, 521 bp, Homo sapiens
  misc_feature: HIJSMM301D9RKT.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtc

SEQ ID NO: 542425 - DNA, 434 bp, Homo sapiens; identical to SEQ ID NO: 535153
  misc_feature: HIJSMM301B4G8R.18.5.A05.1.454.light.4.raw

SEQ ID NO: 542426 - DNA, 484 bp, Homo sapiens
  misc_feature: HIJSMM301CY71G.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagggcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccaag

SEQ ID NO: 542427 - DNA, 447 bp, Homo sapiens; identical to SEQ ID NO: 535201
  misc_feature: HIJSMM301AY7Z7.18.9.A09.1.454.light.4.raw

SEQ ID NO: 542428 - DNA, 476 bp, Homo sapiens
  misc_feature: HIJSMM301A4FD1.49.80.H03.1.454.light.4.raw
agtcgagagacacgaccggtgctcgatttagctgtgcgtcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggtcgggggaccgaaggtggagatcaagcgaactgtgg

SEQ ID NO: 542429 - DNA, 496 bp, Homo sapiens
  misc_feature: HIJSMM301COOUS.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtgacagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 542430 - DNA, 464 bp, Homo sapiens
  misc_feature: HIJSMM301E0SG3.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtggggtcccatcaaggttcagtggcagtggatctgggacagatttcaccctcaccatcagcagtctgcaacctgatgattttgcaacttattattgtcaacagagttacagtatcccgtacacttttggtccaggggaccagggctggatat

SEQ ID NO: 542431 - DNA, 447 bp, Homo sapiens; identical to SEQ ID NO: 535201
  misc_feature: HIJSMM301C8AOE.18.9.A09.1.454.light.4.raw

SEQ ID NO: 542432 - DNA, 472 bp, Homo sapiens
  misc_feature: HIJSMM301DN5JO.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 542433 - DNA, 512 bp, Homo sapiens
  misc_feature: HIJSMM301BQLIV.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcca

SEQ ID NO: 542434 - DNA, 490 bp, Homo sapiens
  misc_feature: HIJSMM301EWHIA.48.35.D02.1.454.light.4.raw
agtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccacggacagacggccaggatcacgtgctctgcagagacgttgccaagtcaatttggtttttggttatcagcagaagtcaggccaggccccaacgactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggcg

SEQ ID NO: 542435 - DNA, 486 bp, Homo sapiens
  misc_feature: HIJSMM301B4S10.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctccggtcactctgttcccaccctcctctacgtgagct

SEQ ID NO: 542436 - DNA, 508 bp, Homo sapiens
  misc_feature: HIJSMM301EDGWB.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttcccg

SEQ ID NO: 542437 - DNA, 413 bp, Homo sapiens
  misc_feature: HIJSMM301C05N3.49.14.B03.1.454.light.4.raw
agtcgagagacacgaccggtgctcgatttagtgtgagtagttccgcgggcacgaccggtgctcgatttagtgtcacacgaagggaaagggccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttcactctcaccatcagcagcctagagcctgaagattctgcagtttattactgtcagcagcgtagcaactggcctctcactttcggcggagggaccaaggtggagatcaaacgaactgtggctgcaccatctgtcttcatcttcccgccatctgatctctcgact

SEQ ID NO: 542438 - DNA, 504 bp, Homo sapiens; identical to SEQ ID NO: 538423
  misc_feature: HIJSMM301AGX3T.48.67.G01.1.454.light.4.raw

SEQ ID NO: 542439 - DNA, 468 bp, Homo sapiens
  misc_feature: HIJSMM301CFW32.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacagggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaacgaactgt

SEQ ID NO: 542440 - DNA, 457 bp, Homo sapiens; identical to SEQ ID NO: 539745
  misc_feature: HIJSMM301DU50O.49.83.H06.1.454.light.4.raw

SEQ ID NO: 542441 - DNA, 518 bp, Homo sapiens
  misc_feature: HIJSMM301EWMWO.41.78.H01.1.454.light.4.raw
tctatactatcacgaccggtgctcgatttagtgtgagtagtttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 542442 - DNA, 454 bp, Homo sapiens
  misc_feature: HIJSMM301EJC7X.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttttcggcggagggaccaagctgaccgtcctaagtcagcccaaggctgccccctcggtcactctgttcccaccctcctccacgagagta

SEQ ID NO: 542443 - DNA, 495 bp, Homo sapiens
  misc_feature: HIJSMM301ASIQ2.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcattc

SEQ ID NO: 542444 - DNA, 470 bp, Homo sapiens
  misc_feature: HIJSMM301BEPA5.49.73.G07.1.454.light.4.raw
agtcgagagacacgaccggtgctcgatttagctctacgctcaggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtgg

SEQ ID NO: 542445 - DNA, 511 bp, Homo sapiens
  misc_feature: HIJSMM301BEVCW.47.85.H08.1.454.light.4.raw
agctcacgtacacgaccggtgctcgatttagtatcactcagtcgcgggggggtcgtcaggaggcagcgctctcaggacatctccaccatggcctgggctctgctgctcctcaccctcctcactcagggcacagggtcctgggcccagtctgccccgactcagcctgcctccgtgtctgggtctcccggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttggtgttcggcggaggaccaagttgaccgtcctaggtcagcccaaggctgccccctcggtcactctgttccca

SEQ ID NO: 542446 - DNA, 441 bp, Homo sapiens; identical to SEQ ID NO: 535074
  misc_feature: HIJSMM301AWQ33.11.3.A03.1.454.light.4.raw

SEQ ID NO: 542447 - DNA, 494 bp, Homo sapiens; identical to SEQ ID NO: 535828
  misc_feature: HIJSMM301EM4J3.3.36.D03.1.454.light.4.raw

SEQ ID NO: 542448 - DNA, 489 bp, Homo sapiens; identical to SEQ ID NO: 536013
  misc_feature: HIJSMM301AFXYS.26.23.C01.1.454.light.4.raw

SEQ ID NO: 542449 - DNA, 518 bp, Homo sapiens; identical to SEQ ID NO: 535407
  misc_feature: HIJSMM301AVBIK.22.30.C08.1.454.light.4.raw

SEQ ID NO: 542450 - DNA, 469 bp, Homo sapiens
  misc_feature: HIJSMM301CI5F6.7.81.H04.1.454.light.4.raw
cgtgtctctacacgaccggtgctcgatttagtagtgtagattcgcggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtgg

SEQ ID NO: 542451 - DNA, 491 bp, Homo sapiens
  misc_feature: HIJSMM301AFVJW.49.81.H04.1.454.light.4.raw
  modified_base (462)..(462): a, c, t, g, unknown or other
agtcgagagacacgaccggtgctcgatttagtagtgtagattcgcgggggcaggagtcagtcccaaccaggacacagcatggacatgagggtccctgctcagctccctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccacctcactttcggcggagggaccgacggtaggngatcaaacgaaacgtgtggctgcaccact

SEQ ID NO: 542452 - DNA, 464 bp, Homo sapiens; identical to SEQ ID NO: 536640
  misc_feature: HIJSMM301AOZGH.26.78.H01.1.454.light.4.raw

SEQ ID NO: 542453 - DNA, 493 bp, Homo sapiens
  misc_feature: HIJSMM301DQLY8.48.28.C06.1.454.light.4.raw
agtatacatacacgaccggtgctcgatttagagctcacgtattgggtttgggggtgggtccaggaggcagaactctgggtgtctcaccatggcctggatccctctacttctccccctcctcttattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 542454 - DNA, 495 bp, Homo sapiens
  misc_feature: HIJSMM301AIOD9.52.37.D04.1.454.light.4.raw
cgcagtacgacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 542455 - DNA, 505 bp, Homo sapiens
  misc_feature: HIJSMM301AJIOZ.15.86.H09.1.454.light.4.raw
tctacgtagccacgaccggtgctcgatttagtgctatagacttgggtttgggggacttccctggtctccttctacctactgcccttcatttcttccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcg

SEQ ID NO: 542456 - DNA, 496 bp, Homo sapiens; identical to SEQ ID NO: 537925
  misc_feature: HIJSMM301AIK7I.22.14.B03.1.454.light.4.raw

SEQ ID NO: 542457 - DNA, 482 bp, Homo sapiens
  misc_feature: HIJSMM301ASBKF.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgcccccctcggtcactctcgttcccgccctcctcgagtagtaca

SEQ ID NO: 542458 - DNA, 503 bp, Homo sapiens
  misc_feature: HIJSMM301DAZ5M.21.22.B11.1.454.light.4.raw
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggngttcggcggagggaccaaactgaccgtcctagggtcagcccaa

SEQ ID NO: 542459 - DNA, 447 bp, Homo sapiens; identical to SEQ ID NO: 535020
  misc_feature: HIJSMM301C554F.18.9.A09.1.454.light.4.raw

SEQ ID NO: 542460 - DNA, 430 bp, Homo sapiens
  misc_feature: HIJSMM301BMHSW.52.15.B04.1.454.light.4.raw
cgcagtacgacacgaccggtgctcgatttagacagtatatatccgcgggggggtctcaggaggcagcgctctcgggacgtctccaccatggcctgggctctgctattcctcaccctcctcactcagggcacagggtcctgggcccagtctgccctgactcagcctaccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacagaaacacttgggtgttcggcggcgggaccaaactgaccgtccttcgtcagcccaaggctgcccctcggtcactctgttcccaccctcctctatacgatcg

SEQ ID NO: 542461 - DNA, 486 bp, Homo sapiens; identical to SEQ ID NO: 537310
  misc_feature: HIJSMM301B7JSD.15.28.C06.1.454.light.4.raw

SEQ ID NO: 542462 - DNA, 498 bp, Homo sapiens
  misc_feature: HIJSMM301EH7LN.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtaggaaatacaaacgaaactgtggctgcaccatctgtcttcatt

SEQ ID NO: 542463 - DNA, 499 bp, Homo sapiens
  misc_feature: HIJSMM301A5WAD.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaactgtggctgcacc

SEQ ID NO: 542464 - DNA, 471 bp, Homo sapiens
  misc_feature: HIJSMM301DBCJH.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactgggtattcggcggagggaccaagctgaccgtcctgagtcagacccg

SEQ ID NO: 542465 - DNA, 483 bp, Homo sapiens; identical to SEQ ID NO: 542009
  misc_feature: HIJSMM301AJMMM.48.22.B11.1.454.light.4.raw

SEQ ID NO: 542466 - DNA, 476 bp, Homo sapiens; identical to SEQ ID NO: 541471
  misc_feature: HIJSMM301C5XDY.13.4.A04.1.454.light.4.raw

SEQ ID NO: 542467 - DNA, 513 bp, Homo sapiens; identical to SEQ ID NO: 535719
  misc_feature: HIJSMM301EBW77.17.33.C11.1.454.light.4.raw

SEQ ID NO: 542468 - DNA, 509 bp, Homo sapiens
  misc_feature: HIJSMM301CFREK.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaggtggagatcaaacgaactgtggctgcaccatctgtcttcta

SEQ ID NO: 542469 - DNA, 481 bp, Homo sapiens
  misc_feature: HIJSMM301AOVIC.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaacgaactgtggctgcaccatctgtctt

SEQ ID NO: 542470 - DNA, 504 bp, Homo sapiens; identical to SEQ ID NO: 535561
  misc_feature: HIJSMM301AJS8H.4.57.F02.1.454.light.4.raw

SEQ ID NO: 542471 - DNA, 491 bp, Homo sapiens
  misc_feature: HIJSMM301EXBFF.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttcc

SEQ ID NO: 542472 - DNA, 489 bp, Homo sapiens; identical to SEQ ID NO: 541933
  misc_feature: HIJSMM301CS1L9.13.46.E02.1.454.light.4.raw

SEQ ID NO: 542473 - DNA, 494 bp, Homo sapiens; identical to SEQ ID NO: 535629
  misc_feature: HIJSMM301EAUZE.4.27.C05.1.454.light.4.raw

SEQ ID NO: 542474 - DNA, 486 bp, Homo sapiens; identical to SEQ ID NO: 535917
  misc_feature: HIJSMM301AZ724.3.10.A10.1.454.light.4.raw

SEQ ID NO: 542475 - DNA, 498 bp, Homo sapiens
  misc_feature: HIJSMM301B2DC7.48.36.D03.1.454.light.4.raw
agtatacatacacgaccggtgctcgatttagctgcgtcacgatctctcttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctcctgaccatctctgggctccaggctgaagatcaggctgattattactgctgttcattttcaagttcctttttgtcttcggaactgggaccgaggtcaccgtcctaggtcagcccaaggccaaccca

SEQ ID NO: 542476 - DNA, 504 bp, Homo sapiens; identical to SEQ ID NO: 540538
  misc_feature: HIJSMM301A3DAA.7.71.G05.1.454.light.4.raw

SEQ ID NO: 542477 - DNA, 496 bp, Homo sapiens; identical to SEQ ID NO: 535109
  misc_feature: HIJSMM301D80QL.16.78.H01.1.454.light.4.raw

SEQ ID NO: 542478 - DNA, 472 bp, Homo sapiens
  misc_feature: HIJSMM301CDPVA.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagacccg

SEQ ID NO: 542479 - DNA, 502 bp, Homo sapiens
  misc_feature: HIJSMM301CZK2U.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgtcggtttattactgtcagcagtataataactggcctccacggtactacttttggccgaggggaccaagctggagatacaaacgaactgtggctgcaccatctgtt

SEQ ID NO: 542480 - DNA, 501 bp, Homo sapiens
  misc_feature: HIJSMM301EGQTA.48.33.C11.1.454.light.4.raw
agtatacatacacgaccggtgctcgatttagagtgagctcgttgggtttggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatgtcaatcgaactgtggctgcaccatctgtcttcatt

SEQ ID NO: 542481 - DNA, 519 bp, Homo sapiens
  misc_feature: HIJSMM301DBGCE.52.57.F02.1.454.light.4.raw
cgcagtacgacacgaccggtgctcgatttagctcgatatagttgggtttgggggggtcgtcaggaggcagcgctctcgggacgtcaccaccatggcctggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcactctgttcccg

SEQ ID NO: 542482 - DNA, 509 bp, Homo sapiens
  misc_feature: HIJSMM301EE2R5.19.78.H01.1.454.light.4.raw
tactctcgtgcacgaccggtgctcgatttagtgtgagtagtttgggtttggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggtccaacccccactgtcta

SEQ ID NO: 542483 - DNA, 490 bp, Homo sapiens
  misc_feature: HIJSMM301CGAMK.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaagggaccagggtggaaagtcaagcgaactgtggctgcaccatctgtctt

SEQ ID NO: 542484 - DNA, 514 bp, Homo sapiens
  misc_feature: HIJSMM301C5WH7.48.53.E09.1.454.light.4.raw
agtatacatacacgaccggtgctcgatttagagagagtgtgttgggtttggggtcagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggt

SEQ ID NO: 542485 - DNA, 494 bp, Homo sapiens
  misc_feature: HIJSMM301BTSC4.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtt

SEQ ID NO: 542486 - DNA, 503 bp, Homo sapiens
  misc_feature: HIJSMM301EJSR4.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaacgaaactgtggctgcaccatctgtt

SEQ ID NO: 542487 - DNA, 448 bp, Homo sapiens
  misc_feature: HIJSMM301DQJHL.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacacgcccccaaactcctcatctacgacaacaccaatcggccctcgaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctcgttccccgcctcctccgtgtctgat

SEQ ID NO: 542488 - DNA, 501 bp, Homo sapiens
  misc_feature: HIJSMM301CWE4Y.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaacccactgtca

SEQ ID NO: 542489 - DNA, 495 bp, Homo sapiens
  misc_feature: HIJSMM301AZYS0.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaaccc

SEQ ID NO: 542490 - DNA, 499 bp, Homo sapiens
  misc_feature: HIJSMM301CEPG2.9.71.G05.1.454.light.4.raw
tgatacgtctcacgaccggtgctcgatttagtgtcgtcgcaagagagagggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctggtcactctgttcccacctcctcagacgtatca

SEQ ID NO: 542491 - DNA, 477 bp, Homo sapiens; identical to SEQ ID NO: 537931
  misc_feature: HIJSMM301BADGJ.48.5.A05.1.454.light.4.raw

SEQ ID NO: 542492 - DNA, 496 bp, Homo sapiens
  misc_feature: HIJSMM301BTJVH.3.10.A10.1.454.light.4.raw
agacgcactccacgaccggtgctcgatttagcgtcgatctcaggggggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcatcttcccgcc

SEQ ID NO: 542493 - DNA, 492 bp, Homo sapiens; identical to SEQ ID NO: 536087
  misc_feature: HIJSMM301CI6IQ.10.17.B06.1.454.light.4.raw

SEQ ID NO: 542494 - DNA, 444 bp, Homo sapiens; identical to SEQ ID NO: 536096
  misc_feature: HIJSMM301ENAW9.7.18.B07.1.454.light.4.raw

SEQ ID NO: 542495 - DNA, 492 bp, Homo sapiens
  misc_feature: HIJSMM301A7GZG.4.33.C11.1.454.light.4.raw
agcactgtagcacgaccggtgctcgatttagagtgagctcgttgggtttggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaaggtggagagtacaaacgaacta

SEQ ID NO: 542496 - DNA, 476 bp, Homo sapiens; identical to SEQ ID NO: 538611
  misc_feature: HIJSMM301AVO2D.7.81.H04.1.454.light.4.raw

SEQ ID NO: 542497 - DNA, 482 bp, Homo sapiens
  misc_feature: HIJSMM301BPO1H.4.43.D10.1.454.light.4.raw
agcactgtagcacgaccggtgctcgatttagactagcagtaagggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactgtggctgcaccatctgtt

SEQ ID NO: 542498 - DNA, 494 bp, Homo sapiens
  misc_feature: HIJSMM301AOFH7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggacggagatcagacgaactagtggcgtgcaccatctgtcttcta

SEQ ID NO: 542499 - DNA, 486 bp, Homo sapiens
  misc_feature: HIJSMM301CE320.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccggtgggggctgaggatgttggcatttattactgcatgcaggctatacaccttcctgccacttttggccaggggaccaagctggagatcaggcgaac

SEQ ID NO: 542500 - DNA, 495 bp, Homo sapiens; identical to SEQ ID NO: 537366
  misc_feature: HIJSMM301DCKOE.5.24.C02.1.454.light.4.raw

SEQ ID NO: 542501 - DNA, 498 bp, Homo sapiens; identical to SEQ ID NO: 536173
  misc_feature: HIJSMM301EP16M.12.86.H09.1.454.light.4.raw

SEQ ID NO: 542502 - DNA, 304 bp, Homo sapiens
  misc_feature: HIJSMM301EORRI.49.33.C11.1.454.light.4.raw
agtcgagagacacgaccggtgctcgatttagagtgagctcgttgggtttgggctgatagttgggtttgggaggagagacccctcccctgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccgccctcctctctctcgact

SEQ ID NO: 542503 - DNA, 447 bp, Homo sapiens; identical to SEQ ID NO: 535201
  misc_feature: HIJSMM301DEK5N.18.9.A09.1.454.light.4.raw

SEQ ID NO: 542504 - DNA, 497 bp, Homo sapiens
  misc_feature: HIJSMM301DCEA5.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgagggtggaaatacaaacgaactagtggctgcaccatctgtcttcat

SEQ ID NO: 542505 - DNA, 419 bp, Homo sapiens
  misc_feature: HIJSMM301CXGWJ.18.59.F04.1.454.light.4.raw
tacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccgagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 542506 - DNA, 493 bp, Homo sapiens
  misc_feature: HIJSMM301B3741.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaacgggacgacgactggagattaaacgaactgtggctgcaccactctgtcttctat

SEQ ID NO: 542507 - DNA, 500 bp, Homo sapiens
  misc_feature: HIJSMM301CLCOK.4.37.D04.1.454.light.4.raw
agcactgtagcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcacgcccaac

SEQ ID NO: 542508 - DNA, 476 bp, Homo sapiens
  misc_feature: HIJSMM301BW7UL.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccggacaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgca

SEQ ID NO: 542509 - DNA, 511 bp, Homo sapiens
  misc_feature: HIJSMM301B0UU4.48.23.C01.1.454.light.4.raw
agtatacatacacgaccggtgctcgatttagtacacgtgattagggattggggagagaagacaggactcaggacaatctccagcatggccagcttccctctcctcctcaccctcctcactcactgtgcagggtcctgggcccagtctgtgctgactcagccaccctcagcgtctggggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccctcggtcactctgttccca

SEQ ID NO: 542510 - DNA, 495 bp, Homo sapiens; identical to SEQ ID NO: 537273
  misc_feature: HIJSMM301EROLC.15.26.C04.1.454.light.4.raw

SEQ ID NO: 542511 - DNA, 513 bp, Homo sapiens
  misc_feature: HIJSMM301AZ5RO.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccacct

SEQ ID NO: 542512 - DNA, 498 bp, Homo sapiens
  misc_feature: HIJSMM301A7PO0.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccgaagctcggtaaggatacacaggaacgtgttggctgcacccactt

SEQ ID NO: 542513 - DNA, 478 bp, Homo sapiens
  misc_feature: HIJSMM301CU36K.48.73.G07.1.454.light.4.raw
agtatacatacacgaccggtgctcgatttagctctacgctcagggcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgtc

SEQ ID NO: 542514 - DNA, 485 bp, Homo sapiens
  misc_feature: HIJSMM301CPLV1.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgtt

SEQ ID NO: 542515 - DNA, 485 bp, Homo sapiens
  misc_feature: HIJSMM301AMGNY.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttctaccatcagcagcctgcagcctgaagatattgcaacatattactgtcaacagtatcataatctccccactttcggccctggaccaaagtggatatcaaacgaactgtggctgcaccatctgt

SEQ ID NO: 542516 - DNA, 517 bp, Homo sapiens; identical to SEQ ID NO: 536980
  misc_feature: HIJSMM301B0B97.5.27.C05.1.454.light.4.raw

SEQ ID NO: 542517 - DNA, 480 bp, Homo sapiens; identical to SEQ ID NO: 535442
  misc_feature: HIJSMM301E2JCB.41.17.B06.1.454.light.4.raw

SEQ ID NO: 542518 - DNA, 468 bp, Homo sapiens
  misc_feature: HIJSMM301DHO9B.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcgaccaagggaccaaggtggaaatcaaacgaactgtggctgcaccatctgtcttcatcttccgccatctgaatagtataga

SEQ ID NO: 542519 - DNA, 501 bp, Homo sapiens; identical to SEQ ID NO: 539914
  misc_feature: HIJSMM301BVDDM.19.78.H01.1.454.light.4.raw

SEQ ID NO: 542520 - DNA, 501 bp, Homo sapiens
  misc_feature: HIJSMM301BM0Z1.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcat

SEQ ID NO: 542521 - DNA, 511 bp, Homo sapiens
  misc_feature: HIJSMM301EMUG0.53.80.H03.1.454.light.4.raw
cgcgtatacacacgaccggtgctcgatttagctgtgcgtcgaagggaaagggttcaggacaatctccagcatggccggcttccctctcctcctcaccctcctcactcactgtgcagggtcctgggcccagtctgtgctgactcagccaccctcagcgtctggggcccccgggcagacagtcaccatctcttgttctggcggcagctccaacatggggcctaactatgcttactggtaccagcagttcccaggagcggcccccaaactcctcatctataggaataatcagcggccctcaggggtccctgaccgattctctggctccaagtctggcacctcagcctccctggccatcagtgggctccggtccgaggatgaggctgattattactgtgcaacatgggatgacagcctgagcggggtgttcggcggagggaccaagctgaccgtcctcggtcagcccaaggctgccccctcggtcactctgttcccgccctcctctcgtactgcg

SEQ ID NO: 542522 - DNA, 493 bp, Homo sapiens; identical to SEQ ID NO: 536471
  misc_feature: HIJSMM301EZHV3.3.71.G05.1.454.light.4.raw

SEQ ID NO: 542523 - DNA, 545 bp, Homo sapiens
  misc_feature: HIJSMM301E1FE2.41.9.A09.1.454.light.4.raw
  modified_base (415)..(415): a, c, t, g, unknown or other
tctatactatcacgaccggtgctcgatttagcgagacgcgcaggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattacngttcagcgtgggatgccagcccgaatcattggggtgttcgggcggaggggacccaaaagtcgtaccggtacccgttacggtcggtacgacccgaaccggaacgtcgtcccccgtcccccggttcgtacct

SEQ ID NO: 542524 - DNA, 455 bp, Homo sapiens
  misc_feature: HIJSMM301BAFBJ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttccccaccctcctccacgagagta

SEQ ID NO: 542525 - DNA, 516 bp, Homo sapiens
  misc_feature: HIJSMM301AIAP2.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaaggctgaccgtcttaagtcagcccaaggcctgccccctcggtcactctcgttcccaccctcct

SEQ ID NO: 542526 - DNA, 493 bp, Homo sapiens; identical to SEQ ID NO: 537281
  misc_feature: HIJSMM301BDWQ9.9.1.A01.1.454.light.4.raw

SEQ ID NO: 542527 - DNA, 478 bp, Homo sapiens; identical to SEQ ID NO: 535129
  misc_feature: HIJSMM301AC95B.11.11.A11.1.454.light.4.raw

SEQ ID NO: 542528 - DNA, 499 bp, Homo sapiens
  misc_feature: HIJSMM301CMKV3.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcat

SEQ ID NO: 542529 - DNA, 507 bp, Homo sapiens
  misc_feature: HIJSMM301AQ9B5.9.12.B01.1.454.light.4.raw
tgatacgtctcacgaccggtgctcgatttagtagtgtagattccgcggggacaacaggcaggcaggggcagcaagatggtgtcgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttggccaagggaccgaacggtggaaagtacaaacgaactagtggctgcaccatctgtcttctatcttccccg

SEQ ID NO: 542530 - DNA, 481 bp, Homo sapiens
  misc_feature: HIJSMM301ETJDG.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatcaaacgaactagtggctgcacca

SEQ ID NO: 542531 - DNA, 491 bp, Homo sapiens; identical to SEQ ID NO: 536211
  misc_feature: HIJSMM301CMYOE.16.53.E09.1.454.light.4.raw

SEQ ID NO: 542532 - DNA, 517 bp, Homo sapiens
  misc_feature: HIJSMM301DY4OV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccgaaacggtagggaaagtacaaacgaaacctagtggctggcaccactctgtcttctatcttccccg

SEQ ID NO: 542533 - DNA, 494 bp, Homo sapiens; identical to SEQ ID NO: 535090
  misc_feature: HIJSMM301DBSVZ.27.78.H01.1.454.light.4.raw
  modified_base (403)..(403): a, c, t, g, unknown or other

SEQ ID NO: 542534 - DNA, 490 bp, Homo sapiens
  misc_feature: HIJSMM301C41C8.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaacgaactgtggctgcaccatctgtcttcatt

SEQ ID NO: 542535 - DNA, 489 bp, Homo sapiens; identical to SEQ ID NO: 535139
  misc_feature: HIJSMM301DDY0M.14.55.E11.1.454.light.4.raw

SEQ ID NO: 542536 - DNA, 503 bp, Homo sapiens
  misc_feature: HIJSMM301A25OL.2.76.G10.1.454.light.4.raw
acgctcgacacacgaccggtgctcgatttagtcactcatacaggggggagagatctggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggt

SEQ ID NO: 542537 - DNA, 489 bp, Homo sapiens; identical to SEQ ID NO: 535386
  misc_feature: HIJSMM301D3TI4.12.51.E07.1.454.light.4.raw

SEQ ID NO: 542538 - DNA, 485 bp, Homo sapiens; identical to SEQ ID NO: 535880
  misc_feature: HIJSMM301ENRH0.7.75.G09.1.454.light.4.raw

SEQ ID NO: 542539 - DNA, 520 bp, Homo sapiens
  misc_feature: HIJSMM301B3NO5.5.27.C05.1.454.light.4.raw
  modified_base (507)..(507): a, c, t, g, unknown or other
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccnccctcctccgtgt

SEQ ID NO: 542540 - DNA, 446 bp, Homo sapiens; identical to SEQ ID NO: 536106
  misc_feature: HIJSMM301BQFYJ.18.9.A09.1.454.light.4.raw

SEQ ID NO: 542541 - DNA, 490 bp, Homo sapiens
  misc_feature: HIJSMM301AXRW0.40.20.B09.1.454.light.4.raw
tctagcgactcacgaccggtgctcgatttagtgtagtgtgaagggggcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaaccccactgtcactctgttcccaccct

SEQ ID NO: 542542 - DNA, 505 bp, Homo sapiens
  misc_feature: HIJSMM301ENLN6.19.85.H08.1.454.light.4.raw
  modified_base (504)..(504): a, c, t, g, unknown or other
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctccggtna

SEQ ID NO: 542543 - DNA, 504 bp, Homo sapiens
  misc_feature: HIJSMM301CGEFD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaatcaaacgaactgtggctgcaccatctgtcttcatcttccccg

SEQ ID NO: 542544 - DNA, 508 bp, Homo sapiens
  misc_feature: HIJSMM301BLD5G.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtacaactgtttcgcgggtcgttcgcgaacggaccgaaggtaggaatacaaacgaactgtggctgcaccactctgtcttctactcttccccg

SEQ ID NO: 542545 - DNA, 493 bp, Homo sapiens
  misc_feature: HIJSMM301BL1OP.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 542546 - DNA, 506 bp, Homo sapiens
  misc_feature: HIJSMM301B733D.5.24.C02.1.454.light.4.raw
atcagacacgcacgaccggtgctcgatttagtacagatcgttagggaaaggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 542547 - DNA, 516 bp, Homo sapiens
  misc_feature: HIJSMM301B5XTK.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgt

SEQ ID NO: 542548 - DNA, 490 bp, Homo sapiens; identical to SEQ ID NO: 535234
  misc_feature: HIJSMM301AVQGH.17.21.B10.1.454.light.4.raw

SEQ ID NO: 542549 - DNA, 518 bp, Homo sapiens
  misc_feature: HIJSMM301DHLVA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaagggaccaacggtaggaagtcgaaacgaacgtacgtggctggcaccaactctgtcttctactcttcccgtcccact

SEQ ID NO: 542550 - DNA, 483 bp, Homo sapiens; identical to SEQ ID NO: 535413
  misc_feature: HIJSMM301AITXH.26.78.H01.1.454.light.4.raw

SEQ ID NO: 542551 - DNA, 491 bp, Homo sapiens; identical to SEQ ID NO: 538524
  misc_feature: HIJSMM301B1U9Q.19.25.C03.1.454.light.4.raw

SEQ ID NO: 542552 - DNA, 505 bp, Homo sapiens; identical to SEQ ID NO: 536117
  misc_feature: HIJSMM301D1I33.8.71.G05.1.454.light.4.raw

SEQ ID NO: 542553 - DNA, 489 bp, Homo sapiens
  misc_feature: HIJSMM301A9D9J.47.41.D08.1.454.light.4.raw
agctcacgtacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatctgtt

SEQ ID NO: 542554 - DNA, 502 bp, Homo sapiens
  misc_feature: HIJSMM301BCN91.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 542555 - DNA, 493 bp, Homo sapiens; identical to SEQ ID NO: 536032
  misc_feature: HIJSMM301EDP35.22.57.F02.1.454.light.4.raw

SEQ ID NO: 542556 - DNA, 498 bp, Homo sapiens; identical to SEQ ID NO: 536173
  misc_feature: HIJSMM301AN7GQ.12.86.H09.1.454.light.4.raw

SEQ ID NO: 542557 - DNA, 495 bp, Homo sapiens; identical to SEQ ID NO: 535596
  misc_feature: HIJSMM301A3RRZ.10.79.H02.1.454.light.4.raw

SEQ ID NO: 542558 - DNA, 470 bp, Homo sapiens
  misc_feature: HIJSMM301BJ7MP.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagatc

SEQ ID NO: 542559 - DNA, 433 bp, Homo sapiens
  misc_feature: HIJSMM301DFSX9.41.8.A08.1.454.light.4.raw
tctatactatcacgaccggtgctcgatttagcatactctacagggaagatggagactgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtgggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcaccatctgtcttcatcttcccgccatctgaatagtataga

SEQ ID NO: 542560 - DNA, 487 bp, Homo sapiens
  misc_feature: HIJSMM301AZTET.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagagaa

SEQ ID NO: 542561 - DNA, 383 bp, Homo sapiens; identical to SEQ ID NO: 447524
  misc_feature: HIJSMM301ALAKM.41.26.C04.1.454.light.4.raw

SEQ ID NO: 542562 - DNA, 455 bp, Homo sapiens
  misc_feature: HIJSMM301AYC55.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccgccctcctccacgagagta

SEQ ID NO: 542563 - DNA, 489 bp, Homo sapiens; identical to SEQ ID NO: 535139
  misc_feature: HIJSMM301CZLEP.14.55.E11.1.454.light.4.raw

SEQ ID NO: 542564 - DNA, 444 bp, Homo sapiens; identical to SEQ ID NO: 535192
  misc_feature: HIJSMM301BI7GB.5.9.A09.1.454.light.4.raw

SEQ ID NO: 542565 - DNA, 493 bp, Homo sapiens
  misc_feature: HIJSMM301CLAP2.48.71.G05.1.454.light.4.raw
agtatacatacacgaccggtgctcgatttagtgtcgtcgcaagagagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccatctgatatgtatact

SEQ ID NO: 542566 - DNA, 444 bp, Homo sapiens; identical to SEQ ID NO: 535027
  misc_feature: HIJSMM301CCFHW.8.73.G07.1.454.light.4.raw

SEQ ID NO: 542567 - DNA, 504 bp, Homo sapiens; identical to SEQ ID NO: 535561
  misc_feature: HIJSMM301CAYEG.4.57.F02.1.454.light.4.raw

SEQ ID NO: 542568 - DNA, 493 bp, Homo sapiens; identical to SEQ ID NO: 536969
  misc_feature: HIJSMM301DZW42.27.78.H01.1.454.light.4.raw

SEQ ID NO: 542569 - DNA, 506 bp, Homo sapiens
  misc_feature: HIJSMM301ETDO3.40.56.F01.1.454.light.4.raw
tctagcgactcacgaccggtgctcgatttagcagacgtctgaacacacaaaggggggaggtcagacccacgtcaggacacagcatggacatgagggtccccgcctcagctcctggggctcctgctgctctggctcccaggtgccaattgtggacatccaggatgacccagtctccctccaccctgtctgcctctattggagacagggtcaacatcacttgccgggccagtcggaggatttatacctggttggcctggtatcagcagaaaccagggaaagcccctgacctcctgatctttaaggcgtctactttggagacatgggtcccatcaaggttcagcggcagtggatccgagacagaattcactctcaccatcagcagcctgcagccggatgattttgcaacttattactgccaacaatattacagttatcctcggacgttcgtccaggaccgacggtggaagtacagacgaactagtggcgtgcaccaactctcgtcttct

SEQ ID NO: 542570 - DNA, 493 bp, Homo sapiens; identical to SEQ ID NO: 535745
  misc_feature: HIJSMM301DN84R.47.78.H01.1.454.light.4.raw

SEQ ID NO: 542571 - DNA, 495 bp, Homo sapiens
  misc_feature: HIJSMM301CWOKN.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactgtggctgcaccatctgtcttcatt

SEQ ID NO: 542572 - DNA, 512 bp, Homo sapiens
  misc_feature: HIJSMM301AYSWQ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaagtacaaacgaactagtggcgtgcaccatctgtcttctatcttccgtccact

SEQ ID NO: 542573 - DNA, 517 bp, Homo sapiens; identical to SEQ ID NO: 541596
  misc_feature: HIJSMM301CQA4R.19.80.H03.1.454.light.4.raw

SEQ ID NO: 542574 - DNA, 494 bp, Homo sapiens; identical to SEQ ID NO: 535629
  misc_feature: HIJSMM301DZMPY.4.27.C05.1.454.light.4.raw

SEQ ID NO: 542575 - DNA, 504 bp, Homo sapiens
  misc_feature: HIJSMM301AOWXU.49.10.A10.1.454.light.4.raw
agtcgagagacacgaccggtgctcgatttagcgtcgatctcagggcacgaccggtgctcgatttagagagcgtcacagagagaagggcacgaccggtgctcgatttagatcgtctgtgttgggtttggggactgttcctcagtgtctgcggccccaggacagaaggtcaccatctcctgctctgcaagcaggtccaatattgcgaatgagtatgtttcctggtaccagcacctcccaggaacagtccccaaactcctcatttatgacaataataggcgaccctcagggattcctgaccgattctctggctccaagtctgccgcgtcagccaccctgggcatcaccggactccagactggggacgagggcgattattactgcgcaataggggatagaagtctgagtgctggcagggtgttcggcggagggaccaagctgaccgtcctaggtcagcccaaggctgccccctcggtcactctgttcccgccctcctctctctcgact

SEQ ID NO: 542576 - DNA, 485 bp, Homo sapiens
  misc_feature: HIJSMM301D0MAZ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccactctcctcgctacgtaga

SEQ ID NO: 542577 - DNA, 516 bp, Homo sapiens
  misc_feature: HIJSMM301B3SD4.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaaccccaattatgtcttcggaactgggaccaaggtcaccgtcctaggtcagcccaaggccaacccca

SEQ ID NO: 542578 - DNA, 482 bp, Homo sapiens
  misc_feature: HIJSMM301AZ6S8.52.23.C01.1.454.light.4.raw
cgcagtacgacacgaccggtgctcgatttagtacacgtgattagggattgggggagtcagtcccaaccaggacacagcatggacatgagggtccctgctcagctcctggggctcctgctgctctgactctcaggtgccagatgtgacatccagatgacccagtctccatcctcctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaagtggagatcagacgaactgtggctgcaccat

SEQ ID NO: 542579 - DNA, 474 bp, Homo sapiens; identical to SEQ ID NO: 537034
  misc_feature: HIJSMM301DH694.5.15.B04.1.454.light.4.raw

SEQ ID NO: 542580 - DNA, 481 bp, Homo sapiens
  misc_feature: HIJSMM301BUC5G.51.40.D07.1.454.light.4.raw
cgatcgtatacacgaccggtgctcgatttagtgatagagcgtaacaacagaggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctcccactcactttcggcggagggaccaaggtggagatcaaacgaactgtggctgcaccat

SEQ ID NO: 542581 - DNA, 484 bp, Homo sapiens
  misc_feature: HIJSMM301A4GHI.49.81.H04.1.454.light.4.raw
agtcgagagacacgaccggtgctcgatttagtagtgtagattcgcggggggagtcagtcccaacccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatct

SEQ ID NO: 542582 - DNA, 491 bp, Homo sapiens; identical to SEQ ID NO: 538021
  misc_feature: HIJSMM301ECM0S.3.72.G06.1.454.light.4.raw

SEQ ID NO: 542583 - DNA, 496 bp, Homo sapiens; identical to SEQ ID NO: 535109
  misc_feature: HIJSMM301B29W2.16.78.H01.1.454.light.4.raw

SEQ ID NO: 542584 - DNA, 493 bp, Homo sapiens
  misc_feature: HIJSMM301B9T7K.5.39.D06.1.454.light.4.raw
  modified_base (481)..(481): a, c, t, g, unknown or other
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgtcgtccgagggacggaaggtacggaaagtaagagacgaactagtggtcgtggnaccaactctgtt

SEQ ID NO: 542585 - DNA, 514 bp, Homo sapiens
  misc_feature: HIJSMM301DZMRU.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtgggcaggtcagcccaaggccaaccccactgtcact

SEQ ID NO: 542586 - DNA, 507 bp, Homo sapiens
  misc_feature: HIJSMM301D47XJ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaacgaactgtggctgcaccatctgtcttcta

SEQ ID NO: 542587 - DNA, 484 bp, Homo sapiens
  misc_feature: HIJSMM301DIO09.46.35.D02.1.454.light.4.raw
actagcagtacacgaccggtgctcgatttagcacacgatagttgggtttggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaacgaactgtggctgcaccat

SEQ ID NO: 542588 - DNA, 489 bp, Homo sapiens
  misc_feature: HIJSMM301A22BC.52.68.G02.1.454.light.4.raw
cgcagtacgacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaataagaggccctcaggggtccctgatcgcttctctggctccaagtctggcaacacggcctccctgaccatctctgggctccaggctgaggatgaggctgaatatttctgctgctcatatgcaggcggctacacttatgtcttcggaactgggacccaggtcaccgtcctaggtcagccc

SEQ ID NO: 542589 - DNA, 521 bp, Homo sapiens
  misc_feature: HIJSMM301BYCYY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccaccct

SEQ ID NO: 542590 - DNA, 503 bp, Homo sapiens; identical to SEQ ID NO: 535044
  misc_feature: HIJSMM301ANU0W.19.78.H01.1.454.light.4.raw

SEQ ID NO: 542591 - DNA, 493 bp, Homo sapiens
  misc_feature: HIJSMM301D5X7O.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacacgactggagattaaaggaactgtggctgcaccatctgtcttcatcttccccg

SEQ ID NO: 542592 - DNA, 494 bp, Homo sapiens; identical to SEQ ID NO: 534992
  misc_feature: HIJSMM301AO6D0.9.1.A01.1.454.light.4.raw

SEQ ID NO: 542593 - DNA, 490 bp, Homo sapiens
  misc_feature: HIJSMM301AF9EO.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggtccgggggaccggaacgtagggtaggagtactaacgaaacgtacgt

SEQ ID NO: 542594 - DNA, 485 bp, Homo sapiens
  misc_feature: HIJSMM301ASEQ2.49.28.C06.1.454.light.4.raw
agtcgagagacacgaccggtgctcgatttagagctcacgtattgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacg

SEQ ID NO: 542595 - DNA, 497 bp, Homo sapiens; identical to SEQ ID NO: 535286
  misc_feature: HIJSMM301C1VSC.18.59.F04.1.454.light.4.raw

SEQ ID NO: 542596 - DNA, 493 bp, Homo sapiens
  misc_feature: HIJSMM301D0XSP.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggaccgaacggacggagatcagacgaactgtggcgtgcaccactctcgtcttcta

SEQ ID NO: 542597 - DNA, 491 bp, Homo sapiens
  misc_feature: HIJSMM301AJAHE.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccgaacggacgaacggtagggatatcagacgaaa

SEQ ID NO: 542598 - DNA, 496 bp, Homo sapiens
  misc_feature: HIJSMM301CDNLE.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccgaggggaccaagctggagatcaaacgaactgtggctgcaccatctgtctt

SEQ ID NO: 542599 - DNA, 508 bp, Homo sapiens
  misc_feature: HIJSMM301A88IP.13.53.E09.1.454.light.4.raw
tcacgtactacacgaccggtgctcgatttagagagagtgtgttgggtttgggggagtcagtctcagtcaggacacagcatggacatgacgggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgttcgcacggaccgaacggtaggaaagtacaagacgaactagtggctggcaccactctgtcttctatcttccgt

SEQ ID NO: 542600 - DNA, 353 bp, Homo sapiens
  misc_feature: HIJSMM301BJL0W.40.9.A09.1.454.light.4.raw
tctagcgactcacgaccggtgctcgatttagcgagacgcgcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcacca

SEQ ID NO: 542601 - DNA, 505 bp, Homo sapiens
  misc_feature: HIJSMM301A2JVD.48.23.C01.1.454.light.4.raw
agtatacatacacgaccggtgctcgatttagtacacgtgattagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtctaggcggtgggacggatcagacagtaggaggtgggttttcgggttccgggacggggaccggaacgactgaccggtaccctaacgtactacgacccg

SEQ ID NO: 542602 - DNA, 404 bp, Homo sapiens; identical to SEQ ID NO: 535530
  misc_feature: HIJSMM301B1VN7.4.35.D02.1.454.light.4.raw

SEQ ID NO: 542603 - DNA, 508 bp, Homo sapiens; identical to SEQ ID NO: 535649
  misc_feature: HIJSMM301A184P.47.55.E11.1.454.light.4.raw

SEQ ID NO: 542604 - DNA, 484 bp, Homo sapiens; identical to SEQ ID NO: 535400
  misc_feature: HIJSMM301CMCX4.46.26.C04.1.454.light.4.raw

SEQ ID NO: 542605 - DNA, 481 bp, Homo sapiens
  misc_feature: HIJSMM301C7RJO.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcggccaagggaccaaggtggatatcagacgaa

SEQ ID NO: 542606 - DNA, 505 bp, Homo sapiens
  misc_feature: HIJSMM301CFR43.16.1.A01.1.454.light.4.raw
tgtactactccacgaccggtgctcgatttagacgtctcatcagggggttcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacacacccaggcaaagcccccaaatcatcatttatgaagtctctaagcggccctcaggggtatctaatcgcttctctggctccaagtctggcaacacggcctcctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 542607 - DNA, 481 bp, Homo sapiens; identical to SEQ ID NO: 535993
  misc_feature: HIJSMM301EUM7R.21.25.C03.1.454.light.4.raw

SEQ ID NO: 542608 - DNA, 503 bp, Homo sapiens; identical to SEQ ID NO: 535140
  misc_feature: HIJSMM301CNLWX.18.37.D04.1.454.light.4.raw

SEQ ID NO: 542609 - DNA, 522 bp, Homo sapiens
  misc_feature: HIJSMM301DI7IR.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactcctgttcccgccctcctcgta

SEQ ID NO: 542610 - DNA, 484 bp, Homo sapiens
  misc_feature: HIJSMM301DGRVK.48.85.H08.1.454.light.4.raw
agtatacatacacgaccggtgctcgatttagtatcactcagtcggcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctccctgaccattactggactccaacctgaggacgaggctgactattattgctcagcatgggacaccagcctcaatgccgcggtattcggcgcagggaccaagctgaccgtcctaggtcacg

SEQ ID NO: 542611 - DNA, 483 bp, Homo sapiens; identical to SEQ ID NO: 536836
  misc_feature: HIJSMM301B82MC.3.38.D05.1.454.light.4.raw

SEQ ID NO: 542612 - DNA, 512 bp, Homo sapiens
  misc_feature: HIJSMM301E0XLQ.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctcgttccccg

SEQ ID NO: 542613 - DNA, 500 bp, Homo sapiens
  misc_feature: HIJSMM301BRPKU.48.59.F04.1.454.light.4.raw
agtatacatacacgaccggtgctcgatttagtacacacacttagggattgggggggaaccgatggaaccccacgcgcagcttctcttcctcctgctactctggctcccagatgcccccggacgaaattgtgttgacgcagtctccagacaccctgtctttgtctccaggggaaagagccaccttctcctgcaggttcagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattaccgtcagcagtatggtagctcaccgatcaccttcggccaagggacacgactggagattaaccgaactgtggctgcaccatctgtcttcatcttcccgccatctgatatgtatact

SEQ ID NO: 542614 - DNA, 489 bp, Homo sapiens
  misc_feature: HIJSMM301CDEOP.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccaaggtggatctcaaaagaactgtggctgcacca

SEQ ID NO: 542615 - DNA, 486 bp, Homo sapiens; identical to SEQ ID NO: 535385
  misc_feature: HIJSMM301AFO66.19.71.G05.1.454.light.4.raw

SEQ ID NO: 542616 - DNA, 493 bp, Homo sapiens
  misc_feature: HIJSMM301DHIJN.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgcccctcggtcact

SEQ ID NO: 542617 - DNA, 488 bp, Homo sapiens
  misc_feature: HIJSMM301DFCMK.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggcccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagccaaggccaaccccactgtcactctgttcccactcctctacgtgagct

SEQ ID NO: 542618 - DNA, 497 bp, Homo sapiens
  misc_feature: HIJSMM301ALHFR.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccgccctcctcgagtagtaca

SEQ ID NO: 542619 - DNA, 488 bp, Homo sapiens
  misc_feature: HIJSMM301BL318.49.46.E02.1.454.light.4.raw
agtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactgacatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 542620 - DNA, 460 bp, Homo sapiens; identical to SEQ ID NO: 537107
  misc_feature: HIJSMM301DA2LW.22.28.C06.1.454.light.4.raw

SEQ ID NO: 542621 - DNA, 507 bp, Homo sapiens
  misc_feature: HIJSMM301DERED.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttccca

SEQ ID NO: 542622 - DNA, 501 bp, Homo sapiens
  misc_feature: HIJSMM301C6LLS.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaacgaactgtggctgcaccatctgtcttcatcttcccg

SEQ ID NO: 542623 - DNA, 478 bp, Homo sapiens
  misc_feature: HIJSMM301CSXGB.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccg

SEQ ID NO: 542624 - DNA, 479 bp, Homo sapiens; identical to SEQ ID NO: 535188
  misc_feature: HIJSMM301AL6GU.10.74.G08.1.454.light.4.raw

SEQ ID NO: 542625 - DNA, 497 bp, Homo sapiens
  misc_feature: HIJSMM301BYVHV.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaaactgtggcgtgcaccatctgtcttcatt

SEQ ID NO: 542626 - DNA, 505 bp, Homo sapiens
  misc_feature: HIJSMM301DZ3B0.41.4.A04.1.454.light.4.raw
tctatactatcacgaccggtgctcgatttagagtagtgatcaggggagagaagagctgctcagttaggacccagagggaaccatggaaaccccagcgcagcttctcttcctcctgctactctggctcccagaagccaccggagaagttgtgttgacgcagtctccggacaccctttctttgtctccaggacaaagagccaccctctcttgtagggccagtgagagtatttccggcaccttcttagcgtggtaccaacagcgacctggccaggctcccaggctcctcttctctgctgcgtatgccagggccgctggcatccctgacaggttcagtggcagtgggtctgggacagacttcactctcaccatcaatagactggagcctgaagattttgcaacatattactgtcaccagtttgcaatctcacccaggacgttcggccaagggaccaacggtaggaaatcaagcgaactgtggctgcaccatctgtcttcatcttcccgt

SEQ ID NO: 542627 - DNA, 492 bp, Homo sapiens; identical to SEQ ID NO: 536175
  misc_feature: HIJSMM301AORV4.19.83.H06.1.454.light.4.raw

SEQ ID NO: 542628 - DNA, 494 bp, Homo sapiens; identical to SEQ ID NO: 534992
  misc_feature: HIJSMM301EHXEZ.9.1.A01.1.454.light.4.raw

SEQ ID NO: 542629 - DNA, 500 bp, Homo sapiens
  misc_feature: HIJSMM301DPAJK.3.27.C05.1.454.light.4.raw
agacgcactccacgaccggtgctcgatttagacgcgatcgaagggtttggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactcctcttccgacgttcggccaagggaccaaggtggaaatcaaacgaactgtggctgacaccat

SEQ ID NO: 542630 - DNA, 492 bp, Homo sapiens
  misc_feature: HIJSMM301C8CCY.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaattttagatgaggccgactattctgtcacacgtgggacatgggcactgcgatcttcggcggagggaccaagctgaccgtcctgggtcagcccaaggctgccccctcggtcact

SEQ ID NO: 542631 - DNA, 498 bp, Homo sapiens
  misc_feature: HIJSMM301ADTQ3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggagggtacgaacggacggaggatcagacgaaccgtgttggcgtgcaccaactctcgtcttct

SEQ ID NO: 542632 - DNA, 491 bp, Homo sapiens; identical to SEQ ID NO: 535176
  misc_feature: HIJSMM301AVHK9.13.39.D06.1.454.light.4.raw

SEQ ID NO: 542633 - DNA, 383 bp, Homo sapiens; identical to SEQ ID NO: 447524
  misc_feature: HIJSMM301EV5SC.41.26.C04.1.454.light.4.raw

SEQ ID NO: 542634 - DNA, 488 bp, Homo sapiens; identical to SEQ ID NO: 537260
  misc_feature: HIJSMM301DUIA1.47.70.G04.1.454.light.4.raw

SEQ ID NO: 542635 - DNA, 503 bp, Homo sapiens
  misc_feature: HIJSMM301BK6YU.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaacaaaatagaggtcaacgaactagtggctgcaccatctgtcttctat

SEQ ID NO: 542636 - DNA, 480 bp, Homo sapiens
  misc_feature: HIJSMM301EMC8D.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtgtgttcggtcggcggg

SEQ ID NO: 542637 - DNA, 493 bp, Homo sapiens; identical to SEQ ID NO: 535745
  misc_feature: HIJSMM301CLVKA.47.78.H01.1.454.light.4.raw

SEQ ID NO: 542638 - DNA, 487 bp, Homo sapiens; identical to SEQ ID NO: 536206
  misc_feature: HIJSMM301DH3H0.47.38.D05.1.454.light.4.raw

SEQ ID NO: 542639 - DNA, 494 bp, Homo sapiens; identical to SEQ ID NO: 534992
  misc_feature: HIJSMM301CKM71.9.1.A01.1.454.light.4.raw

SEQ ID NO: 542640 - DNA, 485 bp, Homo sapiens
  misc_feature: HIJSMM301BO3Z7.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggttggagatcaaacgaa

SEQ ID NO: 542641 - DNA, 454 bp, Homo sapiens; identical to SEQ ID NO: 536347
  misc_feature: HIJSMM301BTY6H.19.86.H09.1.454.light.4.raw

SEQ ID NO: 542642 - DNA, 492 bp, Homo sapiens
  misc_feature: HIJSMM301DKUMF.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 542643 - DNA, 490 bp, Homo sapiens
  misc_feature: HIJSMM301D8S9H.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatccaccttcggccaagggacacgactggagattaaacgaactgtggctgcaccatctgtcttcat

SEQ ID NO: 542644 - DNA, 496 bp, Homo sapiens
  misc_feature: HIJSMM301APCKO.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactagtggctgcaccatctgtctt

SEQ ID NO: 542645 - DNA, 490 bp, Homo sapiens; identical to SEQ ID NO: 538999
  misc_feature: HIJSMM301BCBEQ.16.86.H09.1.454.light.4.raw

SEQ ID NO: 542646 - DNA, 510 bp, Homo sapiens
  misc_feature: HIJSMM301C7UX5.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 542647 - DNA, 504 bp, Homo sapiens; identical to SEQ ID NO: 540538
  misc_feature: HIJSMM301A59Z4.7.71.G05.1.454.light.4.raw

SEQ ID NO: 542648 - DNA, 495 bp, Homo sapiens; identical to SEQ ID NO: 536931
  misc_feature: HIJSMM301D2QKU.10.33.C11.1.454.light.4.raw

SEQ ID NO: 542649 - DNA, 516 bp, Homo sapiens; identical to SEQ ID NO: 542547
  misc_feature: HIJSMM301C2DZO.5.27.C05.1.454.light.4.raw

SEQ ID NO: 542650 - DNA, 446 bp, Homo sapiens; identical to SEQ ID NO: 540335
  misc_feature: HIJSMM301AJ55E.21.22.B11.1.454.light.4.raw

SEQ ID NO: 542651 - DNA, 487 bp, Homo sapiens
  misc_feature: HIJSMM301AR7BM.52.25.C03.1.454.light.4.raw
cgcagtacgacacgaccggtgctcgatttagtagtgtagatttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctggaccaaagtggacatcaaacgaactgtggctgcaccatctgt

SEQ ID NO: 542652 - DNA, 505 bp, Homo sapiens; identical to SEQ ID NO: 535987
  misc_feature: HIJSMM301DK4L2.18.37.D04.1.454.light.4.raw

SEQ ID NO: 542653 - DNA, 474 bp, Homo sapiens
  misc_feature: HIJSMM301AMKX6.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgctaatttattactgtctgcaggattacacataccctcgaacgttcggccaaggaccgaacggtggaaatacaaacgaactagt

SEQ ID NO: 542654 - DNA, 510 bp, Homo sapiens
  misc_feature: HIJSMM301C6FYL.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaaggtgactacttctgtttctcaacagacaccagtgacaatcatgcgattttcggcggagggaccaaagctgaccgtcctgggtcagcccaaggctgccccctcggtcactctgtt

SEQ ID NO: 542655 - DNA, 504 bp, Homo sapiens; identical to SEQ ID NO: 538940
  misc_feature: HIJSMM301E1XBY.2.35.D02.1.454.light.4.raw

SEQ ID NO: 542656 - DNA, 383 bp, Homo sapiens; identical to SEQ ID NO: 447524
  misc_feature: HIJSMM301A2AYO.41.26.C04.1.454.light.4.raw

SEQ ID NO: 542657 - DNA, 503 bp, Homo sapiens
  misc_feature: HIJSMM301BJRWU.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggaccaaggtcaccgtcctaggtcagcccaaggccaaccccta

SEQ ID NO: 542658 - DNA, 495 bp, Homo sapiens; identical to SEQ ID NO: 535007
  misc_feature: HIJSMM301AR42U.22.5.A05.1.454.light.4.raw

SEQ ID NO: 542659 - DNA, 484 bp, Homo sapiens; identical to SEQ ID NO: 536393
  misc_feature: HIJSMM301BVNDO.4.41.D08.1.454.light.4.raw

SEQ ID NO: 542660 - DNA, 483 bp, Homo sapiens; identical to SEQ ID NO: 538138
  misc_feature: HIJSMM301BKNNK.41.34.D01.1.454.light.4.raw

SEQ ID NO: 542661 - DNA, 444 bp, Homo sapiens; identical to SEQ ID NO: 535594
  misc_feature: HIJSMM301C6XN5.9.9.A09.1.454.light.4.raw

SEQ ID NO: 542662 - DNA, 509 bp, Homo sapiens
  misc_feature: HIJSMM301D22SG.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtgacctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgtt

SEQ ID NO: 542663 - DNA, 479 bp, Homo sapiens; identical to SEQ ID NO: 538892
  misc_feature: HIJSMM301DE1KH.22.59.F04.1.454.light.4.raw

SEQ ID NO: 542664 - DNA, 486 bp, Homo sapiens; identical to SEQ ID NO: 536323
  misc_feature: HIJSMM301DXTP4.10.2.A02.1.454.light.4.raw

SEQ ID NO: 542665 - DNA, 348 bp, Homo sapiens
  misc_feature: HIJSMM301B7YBR.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacactttggccaggggaccaagctggagatcaagcgaactgtggctgcaccatctgtcttcatcttcccgccatctgatagtacgtga

SEQ ID NO: 542666 - DNA, 496 bp, Homo sapiens; identical to SEQ ID NO: 537681
  misc_feature: HIJSMM301AFX68.40.23.C01.1.454.light.4.raw

SEQ ID NO: 542667 - DNA, 507 bp, Homo sapiens
  misc_feature: HIJSMM301BCG70.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctggaccgaggtggagatcaaacgaactgtggctgcaccatctgtcttcta

SEQ ID NO: 542668 - DNA, 473 bp, Homo sapiens; identical to SEQ ID NO: 535262
  misc_feature: HIJSMM301A6ALH.8.67.G01.1.454.light.4.raw

SEQ ID NO: 542669 - DNA, 500 bp, Homo sapiens
  misc_feature: HIJSMM301AMV5B.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtctt

SEQ ID NO: 542670 - DNA, 484 bp, Homo sapiens
  misc_feature: HIJSMM301DAEB4.5.36.D03.1.454.light.4.raw
atcagacacgcacgaccggtgctcgatttagctgcgtcacgatctctcttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgca

SEQ ID NO: 542671 - DNA, 495 bp, Homo sapiens
  misc_feature: HIJSMM301AJVAZ.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactagtggctgcaccatctgtcttcatcttcccgcc

SEQ ID NO: 542672 - DNA, 497 bp, Homo sapiens
  misc_feature: HIJSMM301ADU63.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctccccactttcggcggagggaccgagggtgggacgtcaaacgaaactgtggctgcaccatctgtcttctatt

SEQ ID NO: 542673 - DNA, 491 bp, Homo sapiens; identical to SEQ ID NO: 535176
  misc_feature: HIJSMM301ERCZF.13.39.D06.1.454.light.4.raw

SEQ ID NO: 542674 - DNA, 483 bp, Homo sapiens
  misc_feature: HIJSMM301EO4B5.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggtctgttcggcggcgggaccg

SEQ ID NO: 542675 - DNA, 483 bp, Homo sapiens
  misc_feature: HIJSMM301D2B57.49.33.C11.1.454.light.4.raw
agtcgagagacacgaccggtgctcgatttagagtgagctcgttgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaa

SEQ ID NO: 542676 - DNA, 490 bp, Homo sapiens; identical to SEQ ID NO: 541141
  misc_feature: HIJSMM301CW4QR.47.38.D05.1.454.light.4.raw

SEQ ID NO: 542677 - DNA, 487 bp, Homo sapiens; identical to SEQ ID NO: 538190
  misc_feature: HIJSMM301A2ZD3.47.70.G04.1.454.light.4.raw

SEQ ID NO: 542678 - DNA, 470 bp, Homo sapiens; identical to SEQ ID NO: 535302
  misc_feature: HIJSMM301BEYGF.13.76.G10.1.454.light.4.raw

SEQ ID NO: 542679 - DNA, 487 bp, Homo sapiens
  misc_feature: HIJSMM301DHR1D.48.38.D05.1.454.light.4.raw
  modified_base (477)..(477): a, c, t, g, unknown or other
agtatacatacacgaccggtgctcgatttagtatctgatagttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagatttgcaacttattactgtctgcacgattacaattaccctcggacgttcggccaagggaccaacggtggaagtcaacgaactaactggngtcgcgacca

SEQ ID NO: 542680 - DNA, 506 bp, Homo sapiens
  misc_feature: HIJSMM301AU725.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaacggtaggagatcaaacgaaactgtggcgtgcaccactctgtcttctatcttcccg

SEQ ID NO: 542681 - DNA, 485 bp, Homo sapiens
  misc_feature: HIJSMM301EFNYW.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagccccg

SEQ ID NO: 542682 - DNA, 505 bp, Homo sapiens
  misc_feature: HIJSMM301EOQL3.48.58.F03.1.454.light.4.raw
agtatacatacacgaccggtgctcgatttagtctgatcgagaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccgaacgtcggaaatacaaacgaactagtggctgcaccact

SEQ ID NO: 542683 - DNA, 534 bp, Homo sapiens
  misc_feature: HIJSMM301EE494.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcacccccgggcgtcgtccgacggaccgaacggtacggaaggtacgtaaacgaacgtacgtaggtcgtcgcgaccactactcgtcttctactcttcccgtccctactctcgta

SEQ ID NO: 542684 - DNA, 509 bp, Homo sapiens; identical to SEQ ID NO: 536047
  misc_feature: HIJSMM301AS97L.17.33.C11.1.454.light.4.raw

SEQ ID NO: 542685 - DNA, 454 bp, Homo sapiens; identical to SEQ ID NO: 534964
  misc_feature: HIJSMM301EA4GA.19.86.H09.1.454.light.4.raw

SEQ ID NO: 542686 - DNA, 466 bp, Homo sapiens; identical to SEQ ID NO: 536398
  misc_feature: HIJSMM301AP1MK.3.20.B09.1.454.light.4.raw

SEQ ID NO: 542687 - DNA, 501 bp, Homo sapiens; identical to SEQ ID NO: 538461
  misc_feature: HIJSMM301BWL2K.13.11.A11.1.454.light.4.raw

SEQ ID NO: 542688 - DNA, 447 bp, Homo sapiens; identical to SEQ ID NO: 535020
  misc_feature: HIJSMM301CU3C2.18.9.A09.1.454.light.4.raw

SEQ ID NO: 542689 - DNA, 489 bp, Homo sapiens
  misc_feature: HIJSMM301CIX7V.4.64.F09.1.454.light.4.raw
agcactgtagcacgaccggtgctcgatttagcgcgtatacaaggggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgcaacttacttttgtcaacagactaactcattccctcgcagttttggccaggggaccaaggtggagatcaaacgaactgtggctgcaccatctgtcttcatt

SEQ ID NO: 542690 - DNA, 510 bp, Homo sapiens
  misc_feature: HIJSMM301BG5EU.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagccaaggctgccccctcggtcactctgttcccacctcctca

SEQ ID NO: 542691 - DNA, 483 bp, Homo sapiens; identical to SEQ ID NO: 535413
  misc_feature: HIJSMM301AUO5S.26.78.H01.1.454.light.4.raw

SEQ ID NO: 542692 - DNA, 504 bp, Homo sapiens
  misc_feature: HIJSMM301AH8PO.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggtccgaacggaccgaaaggtgggaactacaaacgaaactagtggcgt

SEQ ID NO: 542693 - DNA, 504 bp, Homo sapiens; identical to SEQ ID NO: 536728
  misc_feature: HIJSMM301DF4XE.19.78.H01.1.454.light.4.raw

SEQ ID NO: 542694 - DNA, 487 bp, Homo sapiens
  misc_feature: HIJSMM301BCU7U.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccaaggcgagatcagacgaactgtggctgcaccatctgtcttcta

SEQ ID NO: 542695 - DNA, 441 bp, Homo sapiens
  misc_feature: HIJSMM301AJSZL.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttacttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 542696 - DNA, 506 bp, Homo sapiens
  misc_feature: HIJSMM301BR1CK.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactagtggctgcaccatctgtctt

SEQ ID NO: 542697 - DNA, 493 bp, Homo sapiens
  misc_feature: HIJSMM301C1BHU.14.5.A05.1.454.light.4.raw
cgtctagtaccacgaccggtgctcgatttagatagatagacagggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccaatctgtcttcta

SEQ ID NO: 542698 - DNA, 434 bp, Homo sapiens; identical to SEQ ID NO: 535153
  misc_feature: HIJSMM301BZ2SK.18.5.A05.1.454.light.4.raw

SEQ ID NO: 542699 - DNA, 488 bp, Homo sapiens
  misc_feature: HIJSMM301B11IA.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacc

SEQ ID NO: 542700 - DNA, 493 bp, Homo sapiens; identical to SEQ ID NO: 535084
  misc_feature: HIJSMM301E3H6H.47.64.F09.1.454.light.4.raw

SEQ ID NO: 542701 - DNA, 494 bp, Homo sapiens; identical to SEQ ID NO: 535276
  misc_feature: HIJSMM301CYVOZ.16.6.A06.1.454.light.4.raw

SEQ ID NO: 542702 - DNA, 492 bp, Homo sapiens; identical to SEQ ID NO: 536010
  misc_feature: HIJSMM301AYMFU.10.20.B09.1.454.light.4.raw

SEQ ID NO: 542703 - DNA, 464 bp, Homo sapiens
  misc_feature: HIJSMM301A6AWX.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagacttttactctcaccatcagcagcctgcagcctgaagatattgcaacatattactgtcaacagtatgatcgtctcctcaatttcggccctgggaccagagtggacatgaaacgaa

SEQ ID NO: 542704 - DNA, 491 bp, Homo sapiens
  misc_feature: HIJSMM301C3D0B.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtttcggccaagggaccaaaggtggatatcagacgaa

SEQ ID NO: 542705 - DNA, 487 bp, Homo sapiens
  misc_feature: HIJSMM301AYF0T.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccggtgggggctgaggatgttggcatttattactgcatgcaggctatacaccttcctgccacttttggccaggggaccaagctggagatcaggcgaacg

SEQ ID NO: 542706 - DNA, 423 bp, Homo sapiens; identical to SEQ ID NO: 538400
  misc_feature: HIJSMM301BW430.9.25.C03.1.454.light.4.raw

SEQ ID NO: 542707 - DNA, 447 bp, Homo sapiens; identical to SEQ ID NO: 535201
  misc_feature: HIJSMM301AH7H4.18.9.A09.1.454.light.4.raw

SEQ ID NO: 542708 - DNA, 493 bp, Homo sapiens; identical to SEQ ID NO: 535745
  misc_feature: HIJSMM301BIJ9S.47.78.H01.1.454.light.4.raw

SEQ ID NO: 542709 - DNA, 501 bp, Homo sapiens; identical to SEQ ID NO: 535746
  misc_feature: HIJSMM301EWS7G.18.11.A11.1.454.light.4.raw

SEQ ID NO: 542710 - DNA, 510 bp, Homo sapiens
  misc_feature: HIJSMM301CDOUG.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggcccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttccca

SEQ ID NO: 542711 - DNA, 509 bp, Homo sapiens
  misc_feature: HIJSMM301CUL9C.49.53.E09.1.454.light.4.raw
agtcgagagacacgaccggtgctcgatttagagagagtgtgttggggtttgggggggtccgaggaggcagaactctgggtgtctcaccatggcctggatccctctacttctccccctccctcactctctgcacaggctctggaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactatgtctccgtgttttcggtcggagggaccgaggcgtgaccgtcctgggtcagcccaaggctcgccccctcggtcactctcgtt

SEQ ID NO: 542712 - DNA, 487 bp, Homo sapiens
  misc_feature: HIJSMM301CK9OF.48.53.E09.1.454.light.4.raw
agtatacatacacgaccggtgctcgatttagagagagtgtgttgggtttggggagagctctggagaagagctgctcagttaggacccagagggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaa

SEQ ID NO: 542713 - DNA, 483 bp, Homo sapiens; identical to SEQ ID NO: 535317
  misc_feature: HIJSMM301CMXRE.4.1.A01.1.454.light.4.raw

SEQ ID NO: 542714 - DNA, 454 bp, Homo sapiens; identical to SEQ ID NO: 534964
  misc_feature: HIJSMM301CGAEM.19.86.H09.1.454.light.4.raw

SEQ ID NO: 542715 - DNA, 516 bp, Homo sapiens
  misc_feature: HIJSMM301DKC60.48.17.B06.1.454.light.4.raw
agtatacatacacgaccggtgctcgatttagtcgatagtgaagggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccgctcttatctggattttcggcggaggaccgaagctgaccgcctacgtcagcccaaggctgccccctccggtcactctcgttccaccct

SEQ ID NO: 542716 - DNA, 506 bp, Homo sapiens
  misc_feature: HIJSMM301DUWTR.47.78.H01.1.454.light.4.raw
agctcacgtacacgaccggtgctcgatttagtgtgagtagtttgggtttggggtgatacgagggactcctctagttcaccttctcacaatgacggctccctgctcagctccgtggggctgctaagtgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagacgggccagggcccatctccaaggcgcctaatttataagctttctaaccgggactctggggtcccagacagattcagcggcagtggcactgatgtccacactgacaatcagcagggtggaggctgaggatgttggggtttgttccttccatgcaaggtacacactggccttttggccacggggaccaacctggagatcaaatgaactgtggctgcaccatctgtctt

SEQ ID NO: 542717 - DNA, 521 bp, Homo sapiens
  misc_feature: HIJSMM301BCIRC.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagccccagactcataatttattgatgtcactgatcggccctcaggggtttctaatcgcttctctggctccaagtccggcgacacggcctccctgaccatctccggcctccaggcggaggacgagggtgattatttctgcagctcatttacaaccagccacacccttgctcttcggaactgggaccacggtcatcgtcctaggtcagcccaaggccaaccccactgtcactctgttcccaccctcct

SEQ ID NO: 542718 - DNA, 432 bp, Homo sapiens; identical to SEQ ID NO: 535811
  misc_feature: HIJSMM301B95EI.14.5.A05.1.454.light.4.raw

SEQ ID NO: 542719 - DNA, 488 bp, Homo sapiens; identical to SEQ ID NO: 535081
  misc_feature: HIJSMM301BMMG2.26.23.C01.1.454.light.4.raw

SEQ ID NO: 542720 - DNA, 492 bp, Homo sapiens; identical to SEQ ID NO: 537026
  misc_feature: HIJSMM301BMYGE.53.22.B11.1.454.light.4.raw

SEQ ID NO: 542721 - DNA, 520 bp, Homo sapiens
  misc_feature: HIJSMM301CCCVI.13.36.D03.1.454.light.4.raw
tcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattggaagtaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaaggccggggatgaggccgactattactgtcaggtgtgggatagtagtcgtgagcatgtggtattcggcggagggaccaaactgaccgtcctaggtcagcccaaggctcgccccctcggtcactctgttcccccg

SEQ ID NO: 542722 - DNA, 498 bp, Homo sapiens
  misc_feature: HIJSMM301C4OE1.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactcgtggctgcacca

SEQ ID NO: 542723 - DNA, 454 bp, Homo sapiens; identical to SEQ ID NO: 534964
  misc_feature: HIJSMM301CI5JU.19.86.H09.1.454.light.4.raw

SEQ ID NO: 542724 - DNA, 516 bp, Homo sapiens; identical to SEQ ID NO: 542229
  misc_feature: HIJSMM301C96TY.3.87.H10.1.454.light.4.raw

SEQ ID NO: 542725 - DNA, 489 bp, Homo sapiens
  misc_feature: HIJSMM301DNSLM.10.72.G06.1.454.light.4.raw
catagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttggtatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagccc

SEQ ID NO: 542726 - DNA, 492 bp, Homo sapiens; identical to SEQ ID NO: 536087
  misc_feature: HIJSMM301BADJD.10.17.B06.1.454.light.4.raw

SEQ ID NO: 542727 - DNA, 487 bp, Homo sapiens
  misc_feature: HIJSMM301A26KB.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcggtcactctgttcccaccctcctcga

SEQ ID NO: 542728 - DNA, 493 bp, Homo sapiens; identical to SEQ ID NO: 535084
  misc_feature: HIJSMM301CW09N.47.64.F09.1.454.light.4.raw

SEQ ID NO: 542729 - DNA, 494 bp, Homo sapiens; identical to SEQ ID NO: 534992
  misc_feature: HIJSMM301A4FCF.9.1.A01.1.454.light.4.raw

SEQ ID NO: 542730 - DNA, 487 bp, Homo sapiens; identical to SEQ ID NO: 538190
  misc_feature: HIJSMM301EIF3I.47.70.G04.1.454.light.4.raw

SEQ ID NO: 542731 - DNA, 489 bp, Homo sapiens
  misc_feature: HIJSMM301BGYXG.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccaaggtggagtaatcagacgaa

SEQ ID NO: 542732 - DNA, 482 bp, Homo sapiens
  misc_feature: HIJSMM301BLT3I.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccaggggacacgactggagattaaacgaactgtggctgcaccatct

SEQ ID NO: 542733 - DNA, 415 bp, Homo sapiens; identical to SEQ ID NO: 536118
  misc_feature: HIJSMM301AUV9E.18.78.H01.1.454.light.4.raw

SEQ ID NO: 542734 - DNA, 526 bp, Homo sapiens
  misc_feature: HIJSMM301C0TV2.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtccccaaactcattctttatgatgtcagtaatccggccccgaggggtttctgatcgcttctatggctccaagtctgcctacacggcctccctgaccatctccgggctccagggcctgaggacgaggctgattattattgtagttcatatacaacagtgacacttgggtggttcggcggagggaccaggctgaccgtcctaggtcagcccaaggctcgcccctcggtcactctcgttcccgccct

SEQ ID NO: 542735 - DNA, 485 bp, Homo sapiens
  misc_feature: HIJSMM301CVBH4.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagatcaaacgaact

SEQ ID NO: 542736 - DNA, 444 bp, Homo sapiens; identical to SEQ ID NO: 539971
  misc_feature: HIJSMM301EMIFN.8.73.G07.1.454.light.4.raw
  modified_base (426)..(426): a, c, t, g, unknown or other

SEQ ID NO: 542737 - DNA, 504 bp, Homo sapiens
  misc_feature: HIJSMM301BQHCX.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcaggtggcaggtgggtctggggacagtagttcactctcaccatcagcagcctgcagtctgaagtattttgcggtttattactgtcagcagtataataactggcctccacggtactacttttgccgaggggaccaagctggagatcaaacgaactgtggctgcaccatctgtt

SEQ ID NO: 542738 - DNA, 498 bp, Homo sapiens; identical to SEQ ID NO: 537020
  misc_feature: HIJSMM301A4PWI.26.26.C04.1.454.light.4.raw

SEQ ID NO: 542739 - DNA, 498 bp, Homo sapiens
  misc_feature: HIJSMM301AEVWA.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaagtaggacgatcaagcgaactagtggcgtgcaccactctgtt

SEQ ID NO: 542740 - DNA, 513 bp, Homo sapiens
  misc_feature: HIJSMM301C8FSK.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctcgttcccgccctcctcgctacgtaga

SEQ ID NO: 542741 - DNA, 512 bp, Homo sapiens; identical to SEQ ID NO: 541402
  misc_feature: HIJSMM301D0L2G.43.19.B08.1.454.light.4.raw

SEQ ID NO: 542742 - DNA, 506 bp, Homo sapiens
  misc_feature: HIJSMM301BVPSZ.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccgaagctgaccgtcctaggtcagcccaaggctgccccccg

SEQ ID NO: 542743 - DNA, 475 bp, Homo sapiens
  misc_feature: HIJSMM301DZ9I8.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcaaccg

SEQ ID NO: 542744 - DNA, 459 bp, Homo sapiens
  misc_feature: HIJSMM301BSYFB.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccacctcctcgtatctctcg

SEQ ID NO: 542745 - DNA, 477 bp, Homo sapiens; identical to SEQ ID NO: 537678
  misc_feature: HIJSMM301CK9AL.12.1.A01.1.454.light.4.raw

SEQ ID NO: 542746 - DNA, 447 bp, Homo sapiens; identical to SEQ ID NO: 535020
  misc_feature: HIJSMM301B6KJG.18.9.A09.1.454.light.4.raw

SEQ ID NO: 542747 - DNA, 447 bp, Homo sapiens; identical to SEQ ID NO: 535201
  misc_feature: HIJSMM301CU65S.18.9.A09.1.454.light.4.raw

SEQ ID NO: 542748 - DNA, 505 bp, Homo sapiens; identical to SEQ ID NO: 535503
  misc_feature: HIJSMM301DHP7U.8.28.C06.1.454.light.4.raw

SEQ ID NO: 542749 - DNA, 497 bp, Homo sapiens
  misc_feature: HIJSMM301AMV87.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaaggaccaaggagcaaatacaaacgaactgtggctgcaccatctgtcttcatcttcccgccat

SEQ ID NO: 542750 - DNA, 505 bp, Homo sapiens
  misc_feature: HIJSMM301BL6PM.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaactcctcatatatgaagatgataagcgaccgtcagggattcctgaccgattctctggctccaagtctggcacgtcggccaccctgggcatcgccggactccagactggggacgaggccgatttttactgcggaacatgggataccagcctgcatggtgtggttttcggcggagggaccaagctgaccgtcctaagtcagcccaaggctgccccccg

SEQ ID NO: 542751 - DNA, 483 bp, Homo sapiens; identical to SEQ ID NO: 535413
  misc_feature: HIJSMM301CGEGE.26.78.H01.1.454.light.4.raw

SEQ ID NO: 542752 - DNA, 487 bp, Homo sapiens; identical to SEQ ID NO: 536536
  misc_feature: HIJSMM301AW220.26.45.E01.1.454.light.4.raw

SEQ ID NO: 542753 - DNA, 495 bp, Homo sapiens
  misc_feature: HIJSMM301AGD83.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgactgtggctgcacc

SEQ ID NO: 542754 - DNA, 505 bp, Homo sapiens
  misc_feature: HIJSMM301DN0R6.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactc

SEQ ID NO: 542755 - DNA, 519 bp, Homo sapiens
  misc_feature: HIJSMM301AT51R.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccgcctcct

SEQ ID NO: 542756 - DNA, 434 bp, Homo sapiens; identical to SEQ ID NO: 535153
  misc_feature: HIJSMM301COIVW.18.5.A05.1.454.light.4.raw

SEQ ID NO: 542757 - DNA, 490 bp, Homo sapiens
  misc_feature: HIJSMM301CN2DO.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagttattactgtcaacaatattataataatccatttaatttcggcggagggaccaaggtggagatcaaacgaactgtggctgcaccatctgtcttcatcttcccgcca

SEQ ID NO: 542758 - DNA, 499 bp, Homo sapiens
  misc_feature: HIJSMM301B11M4.9.71.G05.1.454.light.4.raw
tgatacgtctcacgaccggtgctcgatttagtgtcgtcgcaagagagaggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccacctcctcagacgtatca

SEQ ID NO: 542759 - DNA, 487 bp, Homo sapiens; identical to SEQ ID NO: 537573
  misc_feature: HIJSMM301AHPVK.3.10.A10.1.454.light.4.raw

SEQ ID NO: 542760 - DNA, 441 bp, Homo sapiens; identical to SEQ ID NO: 535074
  misc_feature: HIJSMM301DVUSB.11.3.A03.1.454.light.4.raw

SEQ ID NO: 542761 - DNA, 497 bp, Homo sapiens; identical to SEQ ID NO: 536376
  misc_feature: HIJSMM301BTXTQ.22.9.A09.1.454.light.4.raw

SEQ ID NO: 542762 - DNA, 493 bp, Homo sapiens; identical to SEQ ID NO: 535278
  misc_feature: HIJSMM301AYHM6.51.81.H04.1.454.light.4.raw

SEQ ID NO: 542763 - DNA, 493 bp, Homo sapiens; identical to SEQ ID NO: 538136
  misc_feature: HIJSMM301EI7KK.47.64.F09.1.454.light.4.raw

SEQ ID NO: 542764 - DNA, 480 bp, Homo sapiens
  misc_feature: HIJSMM301CE82F.48.26.C04.1.454.light.4.raw
agtatacatacacgaccggtgctcgatttagtctagcgactttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 542765 - DNA, 494 bp, Homo sapiens
  misc_feature: HIJSMM301ADTFP.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactacgtgg

SEQ ID NO: 542766 - DNA, 507 bp, Homo sapiens
  misc_feature: HIJSMM301BCPIO.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaagggaccaaggtggaagtcaagcgaactgtggctgcaccatctgtcttcatcttcccgcc

SEQ ID NO: 542767 - DNA, 501 bp, Homo sapiens; identical to SEQ ID NO: 536867
  misc_feature: HIJSMM301ES8SD.5.86.H09.1.454.light.4.raw

SEQ ID NO: 542768 - DNA, 510 bp, Homo sapiens; identical to SEQ ID NO: 535474
  misc_feature: HIJSMM301BVBEI.17.33.C11.1.454.light.4.raw

SEQ ID NO: 542769 - DNA, 490 bp, Homo sapiens; identical to SEQ ID NO: 535420
  misc_feature: HIJSMM301CTZ8S.3.72.G06.1.454.light.4.raw

SEQ ID NO: 542770 - DNA, 447 bp, Homo sapiens; identical to SEQ ID NO: 535201
  misc_feature: HIJSMM301BA6DC.18.9.A09.1.454.light.4.raw

SEQ ID NO: 542771 - DNA, 487 bp, Homo sapiens
  misc_feature: HIJSMM301DQG32.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcgtcggaggacgaagcggagatcagacgaactgtggctgcaccactctgtcttcta

SEQ ID NO: 542772 - DNA, 455 bp, Homo sapiens
  misc_feature: HIJSMM301ECOQE.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 542773 - DNA, 494 bp, Homo sapiens
  misc_feature: HIJSMM301EU5UQ.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgaagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccgactgt

SEQ ID NO: 542774 - DNA, 511 bp, Homo sapiens; identical to SEQ ID NO: 535406
  misc_feature: HIJSMM301A6KYU.43.59.F04.1.454.light.4.raw

SEQ ID NO: 542775 - DNA, 485 bp, Homo sapiens
  misc_feature: HIJSMM301AE2LC.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtcaaacgaactagtggctgcaccatctgtcttcta

SEQ ID NO: 542776 - DNA, 474 bp, Homo sapiens
  misc_feature: HIJSMM301CQWZT.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggccaagctgaccgtcctaagtcagccc

SEQ ID NO: 542777 - DNA, 502 bp, Homo sapiens
  misc_feature: HIJSMM301EEEIX.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgccccctcggtcactcttcg

SEQ ID NO: 542778 - DNA, 508 bp, Homo sapiens
  misc_feature: HIJSMM301AM1FW.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 542779 - DNA, 466 bp, Homo sapiens; identical to SEQ ID NO: 536398
  misc_feature: HIJSMM301DEI0F.3.20.B09.1.454.light.4.raw

SEQ ID NO: 542780 - DNA, 489 bp, Homo sapiens
  misc_feature: HIJSMM301BM5QQ.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaact

SEQ ID NO: 542781 - DNA, 505 bp, Homo sapiens
  misc_feature: HIJSMM301AUDT6.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcactctgtt

SEQ ID NO: 542782 - DNA, 493 bp, Homo sapiens
  misc_feature: HIJSMM301CZVH6.22.57.F02.1.454.light.4.raw
  modified_base (491)..(491): a, c, t, g, unknown or other
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttnat

SEQ ID NO: 542783 - DNA, 361 bp, Homo sapiens; identical to SEQ ID NO: 540413
  misc_feature: HIJSMM301AIQ2Q.3.57.F02.1.454.light.4.raw

SEQ ID NO: 542784 - DNA, 472 bp, Homo sapiens
  misc_feature: HIJSMM301BSTB1.51.40.D07.1.454.light.4.raw
cgatcgtatacacgaccggtgctcgatttagtgatagagcgtaacaacagagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctccactcactttcgcggaggaccaaggtggagatcaaacgaa

SEQ ID NO: 542785 - DNA, 500 bp, Homo sapiens; identical to SEQ ID NO: 535310
  misc_feature: HIJSMM301A2BEL.47.66.F11.1.454.light.4.raw

SEQ ID NO: 542786 - DNA, 510 bp, Homo sapiens; identical to SEQ ID NO: 535855
  misc_feature: HIJSMM301DVX5K.17.33.C11.1.454.light.4.raw

SEQ ID NO: 542787 - DNA, 487 bp, Homo sapiens
  misc_feature: HIJSMM301BOO7G.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtcaacagtttaataactaccctctcacttttcggaggagggaccagggtggagatcaaacgaactgtggctgcaccatctgt

SEQ ID NO: 542788 - DNA, 512 bp, Homo sapiens
  misc_feature: HIJSMM301EQIGU.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcct

SEQ ID NO: 542789 - DNA, 444 bp, Homo sapiens; identical to SEQ ID NO: 535027
  misc_feature: HIJSMM301A9E4L.8.73.G07.1.454.light.4.raw

SEQ ID NO: 542790 - DNA, 492 bp, Homo sapiens; identical to SEQ ID NO: 534967
  misc_feature: HIJSMM301CSLA3.47.64.F09.1.454.light.4.raw

SEQ ID NO: 542791 - DNA, 443 bp, Homo sapiens
  misc_feature: HIJSMM301EG70C.10.76.G10.1.454.light.4.raw
catagtagtgcacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctccactactatg

SEQ ID NO: 542792 - DNA, 513 bp, Homo sapiens
  misc_feature: HIJSMM301A5F11.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcttcgggcgtcgtccacggacgaacgaggaagtacaaacgaaacaacgtggtgtcgcaccacactcgtcttctactactttccccg

SEQ ID NO: 542793 - DNA, 504 bp, Homo sapiens; identical to SEQ ID NO: 539690
  misc_feature: HIJSMM301D9196.47.65.F10.1.454.light.4.raw

SEQ ID NO: 542794 - DNA, 494 bp, Homo sapiens
  misc_feature: HIJSMM301D8A2C.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtcaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactagtggctgcaccatctgtcttcatcttcccg

SEQ ID NO: 542795 - DNA, 518 bp, Homo sapiens
  misc_feature: HIJSMM301DFRP1.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctcgttcccaccctcctcactactca

SEQ ID NO: 542796 - DNA, 491 bp, Homo sapiens
  misc_feature: HIJSMM301BM7XZ.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccatctgtctt

SEQ ID NO: 542797 - DNA, 498 bp, Homo sapiens
  misc_feature: HIJSMM301EVFOW.43.71.G05.1.454.light.4.raw
tgtgagtagtcacgaccggtgctcgatttagtgtcgtcgcaagagagagggggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaact

SEQ ID NO: 542798 - DNA, 475 bp, Homo sapiens
  misc_feature: HIJSMM301C2QNV.49.76.G10.1.454.light.4.raw
agtcgagagacacgaccggtgctcgatttagtcactcatacagggggaatcagacccagtcaggacacagcatggacatgagagtcctcgctcagctcctggggctcctgctgctctggctcccaggtgccagatgtgacatccagttgacccagtctccatccttcctgtctgcatctgtcggagacagagtcaccatcacttgccgggccagtcagggcgttagtagttatttagcctggtatcaacaaaaaccagggaaagcccctaacctcctgatatatgctgcaaccactttgcaaagtggggtcccatcaaggttcagcggcagtggatctgggacagagttcactctcactatcagcagcctgcagcctgaagattttgcaacttattattgccatcaagttgatgcttacccgctcactttcggcggagggaccaaggtggagatcagacgaactgtggctgcacc

SEQ ID NO: 542799 - DNA, 493 bp, Homo sapiens; identical to SEQ ID NO: 536534
  misc_feature: HIJSMM301BCKUT.43.72.G06.1.454.light.4.raw

SEQ ID NO: 542800 - DNA, 522 bp, Homo sapiens
  misc_feature: HIJSMM301B7ZTH.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaaggtaggaccgtccaaacgaaacctagtggcgtgcaccactctgtcttcctatcttcccgtcccact

SEQ ID NO: 542801 - DNA, 501 bp, Homo sapiens
  misc_feature: HIJSMM301EG2TR.43.69.G03.1.454.light.4.raw
tgtgagtagtcacgaccggtgctcgatttagtcgctgcgtaaaggagaaagggcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccg

SEQ ID NO: 542802 - DNA, 488 bp, Homo sapiens; identical to SEQ ID NO: 535081
  misc_feature: HIJSMM301DUE7N.26.23.C01.1.454.light.4.raw

SEQ ID NO: 542803 - DNA, 516 bp, Homo sapiens
  misc_feature: HIJSMM301C8JVY.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacaagacgaacgtagtggcgtgcgaccatctgttcttctatcttcccgt

SEQ ID NO: 542804 - DNA, 501 bp, Homo sapiens; identical to SEQ ID NO: 539830
  misc_feature: HIJSMM301AUF50.2.76.G10.1.454.light.4.raw

SEQ ID NO: 542805 - DNA, 484 bp, Homo sapiens; identical to SEQ ID NO: 537878
  misc_feature: HIJSMM301ANUO6.17.34.D01.1.454.light.4.raw

SEQ ID NO: 542806 - DNA, 502 bp, Homo sapiens
  misc_feature: HIJSMM301EYCE1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaagggaccaaggtggaaatacaaacgaactagtggctgcaccatctgtcttcatcttccccg

SEQ ID NO: 542807 - DNA, 485 bp, Homo sapiens; identical to SEQ ID NO: 536040
  misc_feature: HIJSMM301EJADQ.15.1.A01.1.454.light.4.raw

SEQ ID NO: 542808 - DNA, 481 bp, Homo sapiens; identical to SEQ ID NO: 540702
  misc_feature: HIJSMM301CRU1F.13.8.A08.1.454.light.4.raw

SEQ ID NO: 542809 - DNA, 516 bp, Homo sapiens
  misc_feature: HIJSMM301C9WAU.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgagctgtatttttactgctgctcatatgcaggtgatcacacttttatgttcgggactgggaccaaggtcaccgtccctaggtcagcccaaggccaacccccactgtcactcttcg

SEQ ID NO: 542810 - DNA, 487 bp, Homo sapiens; identical to SEQ ID NO: 536025
  misc_feature: HIJSMM301B225L.17.34.D01.1.454.light.4.raw

SEQ ID NO: 542811 - DNA, 515 bp, Homo sapiens
  misc_feature: HIJSMM301B0JYU.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagccaaggccaacccactgtcactctcg

SEQ ID NO: 542812 - DNA, 483 bp, Homo sapiens
  misc_feature: HIJSMM301EWA71.51.75.G09.1.454.light.4.raw
cgatcgtatacacgaccggtgctcgatttagtatagacatcaaaacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccactttgcaaagtggagtcccatcgaggttcagtggcagtgggtctgggacagatttctctctcaccattagcagtctgcaacctgaagattttgcaacttactactgtcaacagagttacaatttgcccatcactttcggccaagggacacgactggagattaaacgaactgtggctgcacca

SEQ ID NO: 542813 - DNA, 493 bp, Homo sapiens; identical to SEQ ID NO: 539202
  misc_feature: HIJSMM301DH72F.22.57.F02.1.454.light.4.raw

SEQ ID NO: 542814 - DNA, 515 bp, Homo sapiens
  misc_feature: HIJSMM301AY9C8.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaagcggttgggtgttcggcggagggaccaagctgaccgtcctaggtcagcccaaggctcgcccccctcggtacactctgttccccaccctcctcgctacgt

SEQ ID NO: 542815 - DNA, 476 bp, Homo sapiens
  misc_feature: HIJSMM301AE7G7.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaagctggagaggaacgaactgtggctgcaccat

SEQ ID NO: 542816 - DNA, 517 bp, Homo sapiens; identical to SEQ ID NO: 541596
  misc_feature: HIJSMM301B7954.19.80.H03.1.454.light.4.raw

SEQ ID NO: 542817 - DNA, 497 bp, Homo sapiens
  misc_feature: HIJSMM301B7A7A.49.62.F07.1.454.light.4.raw
agtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 542818 - DNA, 509 bp, Homo sapiens; identical to SEQ ID NO: 541829
  misc_feature: HIJSMM301AROI5.17.28.C06.1.454.light.4.raw

SEQ ID NO: 542819 - DNA, 504 bp, Homo sapiens
  misc_feature: HIJSMM301BC6LV.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 542820 - DNA, 490 bp, Homo sapiens
  misc_feature: HIJSMM301DKEGU.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaagg

SEQ ID NO: 542821 - DNA, 517 bp, Homo sapiens
  misc_feature: HIJSMM301ATK7P.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacaggattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggccaagctgaccgtcctaggtcagcccaaggctgccccctcggtcactctgttcccaccctcctcacg

SEQ ID NO: 542822 - DNA, 507 bp, Homo sapiens
  misc_feature: HIJSMM301C6CDG.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 542823 - DNA, 501 bp, Homo sapiens; identical to SEQ ID NO: 535746
  misc_feature: HIJSMM301C5QE0.18.11.A11.1.454.light.4.raw

SEQ ID NO: 542824 - DNA, 485 bp, Homo sapiens; identical to SEQ ID NO: 539576
  misc_feature: HIJSMM301A1TBG.4.57.F02.1.454.light.4.raw

SEQ ID NO: 542825 - DNA, 496 bp, Homo sapiens; identical to SEQ ID NO: 540132
  misc_feature: HIJSMM301BATTX.3.71.G05.1.454.light.4.raw

SEQ ID NO: 542826 - DNA, 350 bp, Homo sapiens; identical to SEQ ID NO: 537421
  misc_feature: HIJSMM301DE0TS.13.11.A11.1.454.light.4.raw

SEQ ID NO: 542827 - DNA, 509 bp, Homo sapiens
  misc_feature: HIJSMM301CKV15.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggggaccaaactggagatcaaacgaactagtggctgcaccatctgtcttcatcttccccg

SEQ ID NO: 542828 - DNA, 488 bp, Homo sapiens; identical to SEQ ID NO: 537260
  misc_feature: HIJSMM301AVDDU.47.70.G04.1.454.light.4.raw

SEQ ID NO: 542829 - DNA, 491 bp, Homo sapiens; identical to SEQ ID NO: 538021
  misc_feature: HIJSMM301ASP5P.3.72.G06.1.454.light.4.raw

SEQ ID NO: 542830 - DNA, 516 bp, Homo sapiens
  misc_feature: HIJSMM301EQJQ3.15.76.G10.1.454.light.4.raw
tctacgtagccacgaccggtgctcgatttagtcactcatacagggggcggccaggggtcccgttcccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 542831 - DNA, 512 bp, Homo sapiens
  misc_feature: HIJSMM301C86HE.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccaccctcctca

SEQ ID NO: 542832 - DNA, 484 bp, Homo sapiens
  misc_feature: HIJSMM301B8P83.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagagaccaaggtggagatcaaaagaactgtggctgcaccatctgtctt

SEQ ID NO: 542833 - DNA, 502 bp, Homo sapiens; identical to SEQ ID NO: 536253
  misc_feature: HIJSMM301AJCKC.21.22.B11.1.454.light.4.raw

SEQ ID NO: 542834 - DNA, 491 bp, Homo sapiens
  misc_feature: HIJSMM301BSW50.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatcccagatgacccagtcgtccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgttacaccttttggccaggggaccaaactggacatcaaacgaactgtggctgcaccatctgtt

SEQ ID NO: 542835 - DNA, 490 bp, Homo sapiens
  misc_feature: HIJSMM301C0XN8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggaggaccgaaggcggagatcagacgaactgtggctgcaccactctgtcttcta

SEQ ID NO: 542836 - DNA, 486 bp, Homo sapiens
  misc_feature: HIJSMM301CVARF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggatagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 542837 - DNA, 484 bp, Homo sapiens
  misc_feature: HIJSMM301DZQ2Z.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaaccaaggtaggaatcaaacgaactagtggctgcacca

SEQ ID NO: 542838 - DNA, 485 bp, Homo sapiens
  misc_feature: HIJSMM301AM3UZ.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctggtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 542839 - DNA, 515 bp, Homo sapiens
  misc_feature: HIJSMM301AF38S.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaaagcccaagccggtgatgaggctgactatttttgtcaggtgtgggacagcagcatttatgtcttcggacctgggaccaaggtcaccgtcctaggtcagcccaaggccaaccccactgtcactctgttcccaccctcctcga

SEQ ID NO: 542840 - DNA, 487 bp, Homo sapiens; identical to SEQ ID NO: 537009
  misc_feature: HIJSMM301DKVSB.12.88.H11.1.454.light.4.raw

SEQ ID NO: 542841 - DNA, 508 bp, Homo sapiens
  misc_feature: HIJSMM301ALYVZ.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccgaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagcctccctagagcctggagtattttgtagtttattactgtcagcagtatagcagctggcctcccactttcggcggagggaccgaaggtggagatccaacgaactgtggctgcaccatctgtcttcatcttccccg

SEQ ID NO: 542842 - DNA, 518 bp, Homo sapiens
  misc_feature: HIJSMM301CD39A.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacacg

SEQ ID NO: 542843 - DNA, 454 bp, Homo sapiens; identical to SEQ ID NO: 534964
  misc_feature: HIJSMM301A59IY.19.86.H09.1.454.light.4.raw

SEQ ID NO: 542844 - DNA, 467 bp, Homo sapiens; identical to SEQ ID NO: 535997
  misc_feature: HIJSMM301BS9XV.5.36.D03.1.454.light.4.raw

SEQ ID NO: 542845 - DNA, 496 bp, Homo sapiens
  misc_feature: HIJSMM301DTF43.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctccgtgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgactttggccaggggccaagctggagatcagacgaactgtggctgcaccatctgtcttcatcttccccg

SEQ ID NO: 542846 - DNA, 484 bp, Homo sapiens; identical to SEQ ID NO: 535400
  misc_feature: HIJSMM301EONCH.46.26.C04.1.454.light.4.raw

SEQ ID NO: 542847 - DNA, 507 bp, Homo sapiens
  misc_feature: HIJSMM301CBBVH.12.48.E04.1.454.light.4.raw
atacgacgtacacgaccggtgctcgatttagagagcgtcacagagagaagggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcact

SEQ ID NO: 542848 - DNA, 317 bp, Homo sapiens
  misc_feature: HIJSMM301B4KYO.12.1.A01.1.454.light.4.raw
atacgacgtacacgaccggtgctcgatttagacgtctcatcagggtgctgctgaggctgtaggtgctgtccttgctgtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgcaccatctgtcttcatcttcccgacaatctgatacgtcgtat

SEQ ID NO: 542849 - DNA, 475 bp, Homo sapiens
  misc_feature: HIJSMM301D4K4R.4.63.F08.1.454.light.4.raw
agcactgtagcacgaccggtgctcgatttagcgatcgtataaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgtacaagtcagagcattaacatctatttaaattggtatcagcagcaatcagggaaagcccctaaactcctgatctatgatggatccactttggaacatggggtcccttcaaggttcagtggcagtggatctgggacagagttcactctcaccatcagccgtctgcaacctgaagattttgcaacttactactgtcaacagagttacaatctcccgctcactttcggcggagggacgaaggtggagatcaacgaactgtggctgcacc

SEQ ID NO: 542850 - DNA, 503 bp, Homo sapiens; identical to SEQ ID NO: 538973
  misc_feature: HIJSMM301C9BKC.5.86.H09.1.454.light.4.raw

SEQ ID NO: 542851 - DNA, 495 bp, Homo sapiens
  misc_feature: HIJSMM301ADRHB.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcta

SEQ ID NO: 542852 - DNA, 490 bp, Homo sapiens
  misc_feature: HIJSMM301BXBNS.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtgagatcaaacgactgtggctgcaccatctgtcttcatcttcccgccat

SEQ ID NO: 542853 - DNA, 511 bp, Homo sapiens
  misc_feature: HIJSMM301BYO4F.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 542854 - DNA, 484 bp, Homo sapiens
  misc_feature: HIJSMM301CV5EH.14.53.E09.1.454.light.4.raw
  modified_base (454)..(454): a, c, t, g, unknown or other
cgtctagtaccacgaccggtgctcgatttagagagagtgtgttgggtttggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaatcttatcgggtnttcggcggagggaccaagctgaccgtccta

SEQ ID NO: 542855 - DNA, 491 bp, Homo sapiens
  misc_feature: HIJSMM301AI898.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccagggaccaggtggaaatcaaacgaactgtggctgcacatctgtcttcat

SEQ ID NO: 542856 - DNA, 489 bp, Homo sapiens; identical to SEQ ID NO: 542296
  misc_feature: HIJSMM301B2J2M.17.21.B10.1.454.light.4.raw

SEQ ID NO: 542857 - DNA, 434 bp, Homo sapiens; identical to SEQ ID NO: 535153
  misc_feature: HIJSMM301DBEC5.18.5.A05.1.454.light.4.raw

SEQ ID NO: 542858 - DNA, 478 bp, Homo sapiens
  misc_feature: HIJSMM301DSURH.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactcctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggaggaccaggctgaccgtctaggt

SEQ ID NO: 542859 - DNA, 486 bp, Homo sapiens; identical to SEQ ID NO: 535458
  misc_feature: HIJSMM301B11EX.7.75.G09.1.454.light.4.raw

SEQ ID NO: 542860 - DNA, 493 bp, Homo sapiens
  misc_feature: HIJSMM301ES5GE.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacaggtggggtcccgtcaaggttcagtggcagtggatctgggacagatttcactctcaccgtcagcagtctgcaacctgaagtattttgcaacttactactgtcaacagagttacacgtacccccctcactttcggcggaggaccgaaggcggagatcagaacgaactgtggctgcaccatctgtcttcta

SEQ ID NO: 542861 - DNA, 473 bp, Homo sapiens; identical to SEQ ID NO: 535262
  misc_feature: HIJSMM301CHUUE.8.67.G01.1.454.light.4.raw

SEQ ID NO: 542862 - DNA, 491 bp, Homo sapiens; identical to SEQ ID NO: 535176
  misc_feature: HIJSMM301CBIM2.13.39.D06.1.454.light.4.raw

SEQ ID NO: 542863 - DNA, 485 bp, Homo sapiens; identical to SEQ ID NO: 538956
  misc_feature: HIJSMM301C3TCY.40.69.G03.1.454.light.4.raw

SEQ ID NO: 542864 - DNA, 483 bp, Homo sapiens
  misc_feature: HIJSMM301A5GB4.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaaggaccgaaggtaggaagtcaaacgaactagtggctgcaccat

SEQ ID NO: 542865 - DNA, 481 bp, Homo sapiens
  misc_feature: HIJSMM301CWFPY.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaaggtcagaccccg

SEQ ID NO: 542866 - DNA, 377 bp, Homo sapiens; identical to SEQ ID NO: 536071
  misc_feature: HIJSMM301AK4QQ.40.9.A09.1.454.light.4.raw

SEQ ID NO: 542867 - DNA, 503 bp, Homo sapiens
  misc_feature: HIJSMM301BXDPF.14.57.F02.1.454.light.4.raw
cgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccg

SEQ ID NO: 542868 - DNA, 486 bp, Homo sapiens; identical to SEQ ID NO: 537840
  misc_feature: HIJSMM301CZXSG.40.81.H04.1.454.light.4.raw

SEQ ID NO: 542869 - DNA, 444 bp, Homo sapiens; identical to SEQ ID NO: 534993
  misc_feature: HIJSMM301B7AHH.5.9.A09.1.454.light.4.raw

SEQ ID NO: 542870 - DNA, 486 bp, Homo sapiens; identical to SEQ ID NO: 536261
  misc_feature: HIJSMM301ECHQ2.26.55.E11.1.454.light.4.raw

SEQ ID NO: 542871 - DNA, 488 bp, Homo sapiens; identical to SEQ ID NO: 535081
  misc_feature: HIJSMM301A04YC.26.23.C01.1.454.light.4.raw

SEQ ID NO: 542872 - DNA, 510 bp, Homo sapiens
  misc_feature: HIJSMM301EQ27C.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtcggccccaggacagacggccaggacttccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtcctaagtcagcccaaggctgccccctcggtcactctgtt

SEQ ID NO: 542873 - DNA, 487 bp, Homo sapiens; identical to SEQ ID NO: 539157
  misc_feature: HIJSMM301CQ6LG.26.37.D04.1.454.light.4.raw

SEQ ID NO: 542874 - DNA, 476 bp, Homo sapiens
  misc_feature: HIJSMM301ES0ID.41.8.A08.1.454.light.4.raw
tctatactatcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaaacgaactgtggctgcacc

SEQ ID NO: 542875 - DNA, 485 bp, Homo sapiens; identical to SEQ ID NO: 535606
  misc_feature: HIJSMM301BL81F.47.46.E02.1.454.light.4.raw

SEQ ID NO: 542876 - DNA, 495 bp, Homo sapiens; identical to SEQ ID NO: 538588
  misc_feature: HIJSMM301CFUAJ.7.59.F04.1.454.light.4.raw

SEQ ID NO: 542877 - DNA, 486 bp, Homo sapiens; identical to SEQ ID NO: 535043
  misc_feature: HIJSMM301C7TP3.46.35.D02.1.454.light.4.raw

SEQ ID NO: 542878 - DNA, 499 bp, Homo sapiens
  misc_feature: HIJSMM301DUAVQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaacaaccttcggccaaggacgacgactggagattaaaggtaactagtggcgtgcaccatctgtcttctatcttccccg

SEQ ID NO: 542879 - DNA, 486 bp, Homo sapiens; identical to SEQ ID NO: 535043
  misc_feature: HIJSMM301BZ24P.46.35.D02.1.454.light.4.raw

SEQ ID NO: 542880 - DNA, 504 bp, Homo sapiens
  misc_feature: HIJSMM301CBV8L.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 542881 - DNA, 493 bp, Homo sapiens; identical to SEQ ID NO: 535084
  misc_feature: HIJSMM301C7T3Q.47.64.F09.1.454.light.4.raw

SEQ ID NO: 542882 - DNA, 489 bp, Homo sapiens
  misc_feature: HIJSMM301DM3NF.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtgagggaccaaggtggaggtcaaacgaactgtggctgcaccatctgtcttcat

SEQ ID NO: 542883 - DNA, 493 bp, Homo sapiens; identical to SEQ ID NO: 536471
  misc_feature: HIJSMM301AMI8S.3.71.G05.1.454.light.4.raw

SEQ ID NO: 542884 - DNA, 517 bp, Homo sapiens
  misc_feature: HIJSMM301D6280.43.67.G01.1.454.light.4.raw
tgtgagtagtcacgaccggtgctcgatttagagtatacatattgggtttgggcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtac

SEQ ID NO: 542885 - DNA, 494 bp, Homo sapiens; identical to SEQ ID NO: 536974
  misc_feature: HIJSMM301D2UHZ.16.86.H09.1.454.light.4.raw

SEQ ID NO: 542886 - DNA, 510 bp, Homo sapiens
  misc_feature: HIJSMM301DUQES.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccct

SEQ ID NO: 542887 - DNA, 500 bp, Homo sapiens
  misc_feature: HIJSMM301DSRPK.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccaaggtaggaaatacaaacgaactagtggcgtgcacc

SEQ ID NO: 542888 - DNA, 487 bp, Homo sapiens; identical to SEQ ID NO: 541583
  misc_feature: HIJSMM301A2GWS.41.57.F02.1.454.light.4.raw

SEQ ID NO: 542889 - DNA, 441 bp, Homo sapiens; identical to SEQ ID NO: 535074
  misc_feature: HIJSMM301CLAHO.11.3.A03.1.454.light.4.raw

SEQ ID NO: 542890 - DNA, 489 bp, Homo sapiens; identical to SEQ ID NO: 535139
  misc_feature: HIJSMM301DY4SD.14.55.E11.1.454.light.4.raw

SEQ ID NO: 542891 - DNA, 491 bp, Homo sapiens
  misc_feature: HIJSMM301AUTEA.19.71.G05.1.454.light.4.raw
  modified_base (237)..(237): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctggggcgagcgggccaccgatcgaactgcaagtccagccacaatcttttanacagttccaacaatgaaaactacttagcttggtaccagcagagaccaggacagcctcctaggctgctcatttactgggcatctacccgggaatccggggtcctgaccgattcagtggcagcgggtctgggacagatttcactctcaccatcagcagcctgcaggctgaagatgtggcagtttatattgtcaacaatattattataacttcgtggacgttcggtccaagggaccaaggtcggagtatcagacgaa

SEQ ID NO: 542892 - DNA, 498 bp, Homo sapiens
  misc_feature: HIJSMM301AKQFF.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtcccgtgaccgattcagtggcagcgggtctgggacagatttcactctcaccatcagcagcctgcaggttgaagatgtggcagtttattactgtcagcagtattatactactcctctgacgttcggtccaagggaccgaaggtggagatcaaacgaaactgtggctgcaccat

SEQ ID NO: 542893 - DNA, 489 bp, Homo sapiens; identical to SEQ ID NO: 535139
  misc_feature: HIJSMM301CYGQ3.14.55.E11.1.454.light.4.raw

SEQ ID NO: 542894 - DNA, 486 bp, Homo sapiens; identical to SEQ ID NO: 535043
  misc_feature: HIJSMM301BFJ3G.46.35.D02.1.454.light.4.raw

SEQ ID NO: 542895 - DNA, 479 bp, Homo sapiens
  misc_feature: HIJSMM301ED5AH.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 542896 - DNA, 493 bp, Homo sapiens
  misc_feature: HIJSMM301A650M.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttatactgtcagcagtataataactggcctcacggtacacttttggccagggaccaagctggagatcaaacgaactgtggctgcaccatctgt

SEQ ID NO: 542897 - DNA, 497 bp, Homo sapiens; identical to SEQ ID NO: 536371
  misc_feature: HIJSMM301BP6L7.16.78.H01.1.454.light.4.raw

SEQ ID NO: 542898 - DNA, 503 bp, Homo sapiens; identical to SEQ ID NO: 536834
  misc_feature: HIJSMM301B1XWX.2.35.D02.1.454.light.4.raw

SEQ ID NO: 542899 - DNA, 515 bp, Homo sapiens
  misc_feature: HIJSMM301EWX5M.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcattccgggggttttcggcggtagggaccaagctgaccgtcctaggtcagcccaaggctgccccctcggtcactctgttcccg

SEQ ID NO: 542900 - DNA, 504 bp, Homo sapiens
  misc_feature: HIJSMM301ENCK0.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcattcggcggagggaccgaaagctgaccgtcctacggtcagcccaacggctgccccctccggtcact

SEQ ID NO: 542901 - DNA, 481 bp, Homo sapiens; identical to SEQ ID NO: 542530
  misc_feature: HIJSMM301CBTKM.4.74.G08.1.454.light.4.raw

SEQ ID NO: 542902 - DNA, 510 bp, Homo sapiens
  misc_feature: HIJSMM301C9XVT.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaacccactgtcactctgttcccacctcctcga

SEQ ID NO: 542903 - DNA, 491 bp, Homo sapiens
  misc_feature: HIJSMM301B90LG.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccgaaactggatatcagacgaactgtggctgca

SEQ ID NO: 542904 - DNA, 496 bp, Homo sapiens
  misc_feature: HIJSMM301CH1JI.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcggtaacgtttggtccgagggaccgaacgactggagatcagacgaactgtggctgcaccatctgtcttcta

SEQ ID NO: 542905 - DNA, 493 bp, Homo sapiens; identical to SEQ ID NO: 536032
  misc_feature: HIJSMM301BT8D8.22.57.F02.1.454.light.4.raw

SEQ ID NO: 542906 - DNA, 481 bp, Homo sapiens
  misc_feature: HIJSMM301ESJRH.3.28.C06.1.454.light.4.raw
agacgcactccacgaccggtgctcgatttagagctcacgtattgggtttggggagactcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgcaacttattactgccaacagtataatacccgcgtgacgttcggccaagggaccaaaggtggagatcatacgaactgtggctgcaccatctgt

SEQ ID NO: 542907 - DNA, 485 bp, Homo sapiens
  misc_feature: HIJSMM301BV8MC.49.20.B09.1.454.light.4.raw
agtcgagagacacgaccggtgctcgatttagtgtagtgtgaaggggctggggagcctagctgtgctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggt

SEQ ID NO: 542908 - DNA, 503 bp, Homo sapiens; identical to SEQ ID NO: 536834
  misc_feature: HIJSMM301AKKBE.2.35.D02.1.454.light.4.raw

SEQ ID NO: 542909 - DNA, 492 bp, Homo sapiens; identical to SEQ ID NO: 535126
  misc_feature: HIJSMM301CBS9Y.18.11.A11.1.454.light.4.raw

SEQ ID NO: 542910 - DNA, 495 bp, Homo sapiens; identical to SEQ ID NO: 535007
  misc_feature: HIJSMM301BXJ64.22.5.A05.1.454.light.4.raw

SEQ ID NO: 542911 - DNA, 486 bp, Homo sapiens; identical to SEQ ID NO: 537428
  misc_feature: HIJSMM301BA366.47.62.F07.1.454.light.4.raw

SEQ ID NO: 542912 - DNA, 494 bp, Homo sapiens
  misc_feature: HIJSMM301BRB0K.52.34.D01.1.454.light.4.raw
  modified_base (401)..(401): a, c, t, g, unknown or other
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagccctccagtctgaggacgaggggtnactattactgtcaagcggtgggacactggctgtttgggtgttcgggcggagggaccaaggttggaccgtcctaggtcacggcccaaggctccc

SEQ ID NO: 542913 - DNA, 498 bp, Homo sapiens
  misc_feature: HIJSMM301CNYL4.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgcccctcggtcactctcg

SEQ ID NO: 542914 - DNA, 497 bp, Homo sapiens; identical to SEQ ID NO: 536376
  misc_feature: HIJSMM301A4R7B.22.9.A09.1.454.light.4.raw

SEQ ID NO: 542915 - DNA, 502 bp, Homo sapiens
  misc_feature: HIJSMM301D1JBQ.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcact

SEQ ID NO: 542916 - DNA, 473 bp, Homo sapiens
  misc_feature: HIJSMM301BCOWP.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggacacagccactctgaccatcagcgggacccaggctatggatgaggctgactattactgtcaggcgtgggacgatcagcagtgaggtggttttcgggtcgggaggggaccgaaagctgaccgtcct

SEQ ID NO: 542917 - DNA, 480 bp, Homo sapiens
  misc_feature: HIJSMM301BD9GS.48.19.B08.1.454.light.4.raw
agtatacatacacgaccggtgctcgatttagtgagtcagtaagggggctggggtctcaggaggcagcactctcgggacgtctccaccatggcctgggctctgctccgcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcac

SEQ ID NO: 542918 - DNA, 501 bp, Homo sapiens
  misc_feature: HIJSMM301EGTX1.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggacgaagtggagtcaacgaactgtggctgcaccaactctgtcttctatcttcccgt

SEQ ID NO: 542919 - DNA, 479 bp, Homo sapiens
  misc_feature: HIJSMM301CP4PD.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtctaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 542920 - DNA, 490 bp, Homo sapiens; identical to SEQ ID NO: 537951
  misc_feature: HIJSMM301DE2QU.19.57.F02.1.454.light.4.raw

SEQ ID NO: 542921 - DNA, 422 bp, Homo sapiens; identical to SEQ ID NO: 447881
  misc_feature: HIJSMM301BD12A.9.34.D01.1.454.light.4.raw

SEQ ID NO: 542922 - DNA, 418 bp, Homo sapiens; identical to SEQ ID NO: 537546
  misc_feature: HIJSMM301CFFWI.19.86.H09.1.454.light.4.raw

SEQ ID NO: 542923 - DNA, 487 bp, Homo sapiens; identical to SEQ ID NO: 535863
  misc_feature: HIJSMM301C7EAE.19.71.G05.1.454.light.4.raw

SEQ ID NO: 542924 - DNA, 490 bp, Homo sapiens; identical to SEQ ID NO: 535420
  misc_feature: HIJSMM301EG75S.3.72.G06.1.454.light.4.raw

SEQ ID NO: 542925 - DNA, 494 bp, Homo sapiens; identical to SEQ ID NO: 534994
  misc_feature: HIJSMM301EEJOF.27.78.H01.1.454.light.4.raw

SEQ ID NO: 542926 - DNA, 494 bp, Homo sapiens
  misc_feature: HIJSMM301CND1X.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgaccggtggagtgtctaagcgaactgtggcgtgcaccactcttcg

SEQ ID NO: 542927 - DNA, 512 bp, Homo sapiens; identical to SEQ ID NO: 536721
  misc_feature: HIJSMM301DZ2DV.14.70.G04.1.454.light.4.raw

SEQ ID NO: 542928 - DNA, 393 bp, Homo sapiens
  misc_feature: HIJSMM301CRT3X.52.4.A04.1.454.light.4.raw
cgcagtacgacacgaccggtgctcgatttagagtagtgatcagggagtgtccgtctcccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggctgccccctcggtcactctgttcccaccctcctctatacgatcg

SEQ ID NO: 542929 - DNA, 476 bp, Homo sapiens; identical to SEQ ID NO: 536548
  misc_feature: HIJSMM301EFKC9.26.72.G06.1.454.light.4.raw

SEQ ID NO: 542930 - DNA, 499 bp, Homo sapiens
  misc_feature: HIJSMM301C3FKS.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcctaggt

SEQ ID NO: 542931 - DNA, 489 bp, Homo sapiens
  misc_feature: HIJSMM301B32C1.22.65.F10.1.454.light.4.raw
  modified_base (365)..(365): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgnggtctgcaacctgaagatttcgcaacttactactgtcaacagacttacagtgccccccgatcaccttcggccgaacggacgacgactggagattaacgaactgtggctgcacatctgtcttcat

SEQ ID NO: 542932 - DNA, 487 bp, Homo sapiens; identical to SEQ ID NO: 536272
  misc_feature: HIJSMM301CCNKB.17.25.C03.1.454.light.4.raw

SEQ ID NO: 542933 - DNA, 508 bp, Homo sapiens
  misc_feature: HIJSMM301AM18Z.48.38.D05.1.454.light.4.raw
agtatacatacacgaccggtgctcgatttagtatctgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctccggtcactctgtt

SEQ ID NO: 542934 - DNA, 484 bp, Homo sapiens; identical to SEQ ID NO: 536162
  misc_feature: HIJSMM301C3HVO.13.59.F04.1.454.light.4.raw

SEQ ID NO: 542935 - DNA, 494 bp, Homo sapiens; identical to SEQ ID NO: 534992
  misc_feature: HIJSMM301AQHI0.9.1.A01.1.454.light.4.raw

SEQ ID NO: 542936 - DNA, 488 bp, Homo sapiens
  misc_feature: HIJSMM301A7349.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcctc

SEQ ID NO: 542937 - DNA, 497 bp, Homo sapiens
  misc_feature: HIJSMM301COUYS.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcatcatcagcagcctagagcctgaagattttgcagtttattactgtcagcagcgtagcaactggcctcggttcacttttggccaggggaccaagctggagatcaacgaactgtggctgcaccatctgtcttcta

SEQ ID NO: 542938 - DNA, 504 bp, Homo sapiens; identical to SEQ ID NO: 535128
  misc_feature: HIJSMM301AWREX.19.85.H08.1.454.light.4.raw

SEQ ID NO: 542939 - DNA, 479 bp, Homo sapiens; identical to SEQ ID NO: 538734
  misc_feature: HIJSMM301BLTTI.8.53.E09.1.454.light.4.raw

SEQ ID NO: 542940 - DNA, 481 bp, Homo sapiens; identical to SEQ ID NO: 535993
  misc_feature: HIJSMM301AQUUQ.21.25.C03.1.454.light.4.raw

SEQ ID NO: 542941 - DNA, 503 bp, Homo sapiens
  misc_feature: HIJSMM301EG7AL.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcacgcagcactcaagtcttcggaactgggaccaaggtcaccgtcctaggtcagcccaacggccgaacccca

SEQ ID NO: 542942 - DNA, 494 bp, Homo sapiens; identical to SEQ ID NO: 534994
  misc_feature: HIJSMM301AU4FU.27.78.H01.1.454.light.4.raw

SEQ ID NO: 542943 - DNA, 473 bp, Homo sapiens; identical to SEQ ID NO: 535262
  misc_feature: HIJSMM301AKPNO.8.67.G01.1.454.light.4.raw

SEQ ID NO: 542944 - DNA, 502 bp, Homo sapiens
  misc_feature: HIJSMM301DLC63.12.48.E04.1.454.light.4.raw
  modified_base (501)..(501): a, c, t, g, unknown or other
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggaccaccgggcagagggtcaccatttcttgttctggaacccactccaacatcggatataattctgtagactggtaccagcagcttccaggagcggcccccgactcctcatctttaataacaatcagcggccctcaggggtcccgtcgacgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtna

SEQ ID NO: 542945 - DNA, 506 bp, Homo sapiens
  misc_feature: HIJSMM301DL67D.5.59.F04.1.454.light.4.raw
atcagacacgcacgaccggtgctcgatttagtacacacacttagggattggggctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccgaaggtggaaagtacaaacgaactagtggctgcaccatctgtcttctatcttcccgccta

SEQ ID NO: 542946 - DNA, 487 bp, Homo sapiens; identical to SEQ ID NO: 536536
  misc_feature: HIJSMM301DZ8HH.26.45.E01.1.454.light.4.raw

SEQ ID NO: 542947 - DNA, 456 bp, Homo sapiens
  misc_feature: HIJSMM301CDYRI.48.60.F05.1.454.light.4.raw
agtatacatacacgaccggtgctcgatttagtacgtcatcagggaaagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccacctgtcactctgttcccaccctcctctatgtatact

SEQ ID NO: 542948 - DNA, 504 bp, Homo sapiens; identical to SEQ ID NO: 539083
  misc_feature: HIJSMM301DFEBY.8.19.B08.1.454.light.4.raw

SEQ ID NO: 542949 - DNA, 454 bp, Homo sapiens; identical to SEQ ID NO: 536347
  misc_feature: HIJSMM301ER4BZ.19.86.H09.1.454.light.4.raw

SEQ ID NO: 542950 - DNA, 404 bp, Homo sapiens; identical to SEQ ID NO: 535530
  misc_feature: HIJSMM301A16Q0.4.35.D02.1.454.light.4.raw

SEQ ID NO: 542951 - DNA, 453 bp, Homo sapiens; identical to SEQ ID NO: 535173
  misc_feature: HIJSMM301DB70E.19.86.H09.1.454.light.4.raw

SEQ ID NO: 542952 - DNA, 497 bp, Homo sapiens
  misc_feature: HIJSMM301B6VZL.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttcta

SEQ ID NO: 542953 - DNA, 492 bp, Homo sapiens
  misc_feature: HIJSMM301CYRMS.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccaggggaccgaagactggaggatcacaggaactgtggctgcaccat

SEQ ID NO: 542954 - DNA, 482 bp, Homo sapiens
  misc_feature: HIJSMM301D9HA3.4.1.A01.1.454.light.4.raw
agcactgtagcacgaccggtgctcgatttagacgtctcatcagggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggcccacgttcggccaagggccaaggtggaaatcaaacgaactgtggctgcaccatctgtcttcta

SEQ ID NO: 542955 - DNA, 492 bp, Homo sapiens; identical to SEQ ID NO: 535251
  misc_feature: HIJSMM301A0WBC.11.71.G05.1.454.light.4.raw

SEQ ID NO: 542956 - DNA, 492 bp, Homo sapiens; identical to SEQ ID NO: 534967
  misc_feature: HIJSMM301DC8RT.47.64.F09.1.454.light.4.raw

SEQ ID NO: 542957 - DNA, 447 bp, Homo sapiens; identical to SEQ ID NO: 535201
  misc_feature: HIJSMM301C8829.18.9.A09.1.454.light.4.raw

SEQ ID NO: 542958 - DNA, 485 bp, Homo sapiens; identical to SEQ ID NO: 536576
  misc_feature: HIJSMM301B6D25.46.35.D02.1.454.light.4.raw

SEQ ID NO: 542959 - DNA, 491 bp, Homo sapiens
  misc_feature: HIJSMM301BMWU1.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggacgggaccaaggcggagatcagacgaactgtggctgcaccatctgtcttcta

SEQ ID NO: 542960 - DNA, 504 bp, Homo sapiens; identical to SEQ ID NO: 539690
  misc_feature: HIJSMM301C7ECX.47.65.F10.1.454.light.4.raw

SEQ ID NO: 542961 - DNA, 521 bp, Homo sapiens
  misc_feature: HIJSMM301C8VMI.16.66.F11.1.454.light.4.raw
tgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 542962 - DNA, 493 bp, Homo sapiens
  misc_feature: HIJSMM301C8NEZ.14.53.E09.1.454.light.4.raw
cgtctagtaccacgaccggtgctcgatttagagagagtgtgttgggtttgggggggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 542963 - DNA, 489 bp, Homo sapiens; identical to SEQ ID NO: 535250
  misc_feature: HIJSMM301DQ2ND.14.55.E11.1.454.light.4.raw

SEQ ID NO: 542964 - DNA, 447 bp, Homo sapiens; identical to SEQ ID NO: 535201
  misc_feature: HIJSMM301C4NMI.18.9.A09.1.454.light.4.raw

SEQ ID NO: 542965 - DNA, 487 bp, Homo sapiens
  misc_feature: HIJSMM301EZT3P.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaaactcctctcactttcggcggagggaccaaggtgagatcaaacgaactgt

SEQ ID NO: 542966 - DNA, 502 bp, Homo sapiens
  misc_feature: HIJSMM301EUZ9Q.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggccccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccc

SEQ ID NO: 542967 - DNA, 482 bp, Homo sapiens; identical to SEQ ID NO: 535216
  misc_feature: HIJSMM301DPDR9.17.26.C04.1.454.light.4.raw

SEQ ID NO: 542968 - DNA, 504 bp, Homo sapiens
  misc_feature: HIJSMM301AG8BC.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatcttccccg

SEQ ID NO: 542969 - DNA, 465 bp, Homo sapiens
  misc_feature: HIJSMM301A91XW.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttattctgtctacaagattctaattaccctcggacgctcggccaggggaccaaagtggatgtcaaccgaa

SEQ ID NO: 542970 - DNA, 504 bp, Homo sapiens
  misc_feature: HIJSMM301C4747.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcgacgggacgcaacagtgggatgacaatctgagcggttgggtgttcggcggagggaccaaatgaccgtcctaggtcagcccaa

SEQ ID NO: 542971 - DNA, 488 bp, Homo sapiens
  misc_feature: HIJSMM301EKJSN.40.20.B09.1.454.light.4.raw
tctagcgactcacgaccggtgctcgatttagtgtagtgtgaaggggggcctcaggaagccgcatcggaggtgcctcagccatggcatggatccctctcttcctcggcgtccttgcttactgcacaggatccgtggcctcctctgagttgactcagccaccctcagtgtccgtgtcccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaacccactgtca

SEQ ID NO: 542972 - DNA, 512 bp, Homo sapiens
  misc_feature: HIJSMM301BVBBZ.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccacggaccgaacggtaggaaagtacaagacgaactacgtggcgtgcaccactctgtcttctatcttcccgt

SEQ ID NO: 542973 - DNA, 492 bp, Homo sapiens
  misc_feature: HIJSMM301DN7OT.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttca

SEQ ID NO: 542974 - DNA, 494 bp, Homo sapiens
  misc_feature: HIJSMM301AGAYM.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaacgggacacgactggagattaaacgtaactgtggctgcaccactctgtcttctat

SEQ ID NO: 542975 - DNA, 447 bp, Homo sapiens; identical to SEQ ID NO: 535020
  misc_feature: HIJSMM301DDXS3.18.9.A09.1.454.light.4.raw

SEQ ID NO: 542976 - DNA, 508 bp, Homo sapiens
  misc_feature: HIJSMM301A3AR7.40.47.E03.1.454.light.4.raw
tctagcgactcacgaccggtgctcgatttagactcgcgcacagagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcact

SEQ ID NO: 542977 - DNA, 447 bp, Homo sapiens; identical to SEQ ID NO: 535020
  misc_feature: HIJSMM301AK44L.18.9.A09.1.454.light.4.raw

SEQ ID NO: 542978 - DNA, 486 bp, Homo sapiens; identical to SEQ ID NO: 536323
  misc_feature: HIJSMM301B33FV.10.2.A02.1.454.light.4.raw

SEQ ID NO: 542979 - DNA, 306 bp, Homo sapiens
  misc_feature: HIJSMM301AODAD.49.19.B08.1.454.light.4.raw
agtcgagagacacgaccggtgctcgatttagtgagtcagtaagggcccccaggactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccgccctcctctctctcgact

SEQ ID NO: 542980 - DNA, 489 bp, Homo sapiens
  misc_feature: HIJSMM301AD20K.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccacaatatgatatttattctccagcgttcggccagggaccgaaggtggaagtcaagcgaactagtggctgcaccatctgtt

SEQ ID NO: 542981 - DNA, 493 bp, Homo sapiens
  misc_feature: HIJSMM301A26A9.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggtcggagggaccgaaggtaggaggagtacaaacgaact

SEQ ID NO: 542982 - DNA, 488 bp, Homo sapiens; identical to SEQ ID NO: 535081
  misc_feature: HIJSMM301A30E2.26.23.C01.1.454.light.4.raw

SEQ ID NO: 542983 - DNA, 505 bp, Homo sapiens
  misc_feature: HIJSMM301D88OV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatctgtcttctatcttcccg

SEQ ID NO: 542984 - DNA, 512 bp, Homo sapiens
  misc_feature: HIJSMM301AVMEJ.15.76.G10.1.454.light.4.raw
  modified_base (370)..(370): a, c, t, g, unknown or other
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtntgcagcctgaggacgaggctgactattactgcctactctactttggtggtgctgtgctattcggcggagggaccaagctgaccgtcttaagtcagcccaaggctgccccctcggtcactctgttcccgcctcctccgctacg

SEQ ID NO: 542985 - DNA, 479 bp, Homo sapiens; identical to SEQ ID NO: 535118
  misc_feature: HIJSMM301BBAS7.13.59.F04.1.454.light.4.raw

SEQ ID NO: 542986 - DNA, 505 bp, Homo sapiens; identical to SEQ ID NO: 535503
  misc_feature: HIJSMM301B5R4N.8.28.C06.1.454.light.4.raw

SEQ ID NO: 542987 - DNA, 434 bp, Homo sapiens; identical to SEQ ID NO: 535153
  misc_feature: HIJSMM301BZXJ5.18.5.A05.1.454.light.4.raw

SEQ ID NO: 542988 - DNA, 501 bp, Homo sapiens; identical to SEQ ID NO: 538461
  misc_feature: HIJSMM301ENZB1.13.11.A11.1.454.light.4.raw

SEQ ID NO: 542989 - DNA, 513 bp, Homo sapiens
  misc_feature: HIJSMM301CRBPU.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacg

SEQ ID NO: 542990 - DNA, 520 bp, Homo sapiens
  misc_feature: HIJSMM301A9R8A.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaagggaccgaacggtagggaaggtacgaaacgaaacctagtggcgtgcaccactctgtcttctatcttcccgccact

SEQ ID NO: 542991 - DNA, 486 bp, Homo sapiens
  misc_feature: HIJSMM301DM6QE.41.50.E06.1.454.light.4.raw
tctatactatcacgaccggtgctcgatttagatctactgacaacacacaaggggtgatcaggactcctcagttcaccttctcacaatgaggctccctgctcagctcctggggctgctaatgctctgggtctctggatccactggggctgttgtgatgacacagtctccactctccctgcccatcacccctggcgagccggcctccatctcctgtaggtctagtctgagcctcctgtctagtagtggagacaactatttggattggtacctgcagaagccagggcagtctccacaactcctgatttatttgggttttcatcgggcctccggggtccctgacaggttcagtggcagtggatcaggcacagattttacactgagtatcagcacagtggaggctgaggatgttggggtttattattgtgtgcaaactctacacttccacgtggacgttcggccacgggacgagggtggatatcaaacgaa

SEQ ID NO: 542992 - DNA, 487 bp, Homo sapiens; identical to SEQ ID NO: 536025
  misc_feature: HIJSMM301B58DE.17.34.D01.1.454.light.4.raw

SEQ ID NO: 542993 - DNA, 477 bp, Homo sapiens
  misc_feature: HIJSMM301EK6AC.49.27.C05.1.454.light.4.raw
agtcgagagacacgaccggtgctcgatttagacgcgatcgaagggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgcacca

SEQ ID NO: 542994 - DNA, 493 bp, Homo sapiens
  misc_feature: HIJSMM301AOWH2.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggctagtttattattgtcaaacaatattattatacttcgtggacgttcggccgaacggaccgaaggtggatatcagacgaa

SEQ ID NO: 542995 - DNA, 501 bp, Homo sapiens
  misc_feature: HIJSMM301DDDQF.49.45.E01.1.454.light.4.raw
agtcgagagacacgaccggtgctcgatttagtgagtcagtaagggaaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctggtcactctcg

SEQ ID NO: 542996 - DNA, 521 bp, Homo sapiens
  misc_feature: HIJSMM301BVPX3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctggaccgtcctaggtcagccaaggctgccccctcggtcactctgttcccaccct

SEQ ID NO: 542997 - DNA, 495 bp, Homo sapiens
  misc_feature: HIJSMM301BRAWM.9.1.A01.1.454.light.4.raw
  modified_base (478)..(478): a, c, t, g, unknown or other
tgatacgtctcacgaccggtgctcgatttagacgtctcatcagggggagctgctcagttaggacccagagggaaccatggaaaccccacgcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatntgtcttcatcttccccg

SEQ ID NO: 542998 - DNA, 466 bp, Homo sapiens
  misc_feature: HIJSMM301AU1D9.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtgaccgattctctggctccatgtctggcacctcagcctccctgaccatcagtgggctccggtccgaggatgaggctgattattactgtgcaccgtgggatgacatcctgaatggtccggtgttcggcggagggaccgaggctgaccgtcctaagtcagcccaaggctgccccctcggtcactctgttcccaccctcctcctagtctacg

SEQ ID NO: 542999 - DNA, 486 bp, Homo sapiens
  misc_feature: HIJSMM301EH33V.17.55.E11.1.454.light.4.raw
cgtagactagcacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacagtaagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggagatcaaacgaa

SEQ ID NO: 543000 - DNA, 505 bp, Homo sapiens; identical to SEQ ID NO: 535503
  misc_feature: HIJSMM301DBF7R.8.28.C06.1.454.light.4.raw

SEQ ID NO: 543001 - DNA, 493 bp, Homo sapiens
  misc_feature: HIJSMM301EKYCO.48.27.C05.1.454.light.4.raw
agtatacatacacgaccggtgctcgatttagacgcgatcgaagggtttggggaaccatggaagcccacgcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacacttttggccaggggaccacgctggagatcaaacgaactgtggctgcaccatctgtcttcatcttcccgccatctgatatgta

SEQ ID NO: 543002 - DNA, 516 bp, Homo sapiens
  misc_feature: HIJSMM301A7ZQL.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtgtccacggaccgaacggtaggagtacgaacgaaactacgtggcgtgtcgaccactctcgtcttctactcttcccgccctact

SEQ ID NO: 543003 - DNA, 503 bp, Homo sapiens
  misc_feature: HIJSMM301EH3V8.13.37.D04.1.454.light.4.raw
tcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctgtt

SEQ ID NO: 543004 - DNA, 447 bp, Homo sapiens; identical to SEQ ID NO: 535020
  misc_feature: HIJSMM301B7CJE.18.9.A09.1.454.light.4.raw

SEQ ID NO: 543005 - DNA, 486 bp, Homo sapiens; identical to SEQ ID NO: 535385
  misc_feature: HIJSMM301EHNM3.19.71.G05.1.454.light.4.raw

SEQ ID NO: 543006 - DNA, 499 bp, Homo sapiens
  misc_feature: HIJSMM301ETQEU.48.23.C01.1.454.light.4.raw
agtatacatacacgaccggtgctcgatttagtacacgtgattagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 543007 - DNA, 500 bp, Homo sapiens; identical to SEQ ID NO: 535310
  misc_feature: HIJSMM301A17TH.47.66.F11.1.454.light.4.raw

SEQ ID NO: 543008 - DNA, 418 bp, Homo sapiens
  misc_feature: HIJSMM301BH5SZ.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagccccaaggccaaccccactgtcactctgttccccgccctcctcgagtagtaca

SEQ ID NO: 543009 - DNA, 443 bp, Homo sapiens
  misc_feature: HIJSMM301EMEEG.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagccaaggctgccccctcggtcactctgttcccaccctcctctgtcgagcgt

SEQ ID NO: 543010 - DNA, 512 bp, Homo sapiens
  misc_feature: HIJSMM301AMFWC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccgaagggaccgaacggtaggaaagtacaaacgaaacctagtggctgcgaccatctgtcttctatcttccccg

SEQ ID NO: 543011 - DNA, 498 bp, Homo sapiens
  misc_feature: HIJSMM301DCT96.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggtccaagggaccaaggtggaagtcgaaacgaacctagtggctgcaccatctgtcttcatcttcccgt

SEQ ID NO: 543012 - DNA, 495 bp, Homo sapiens
  misc_feature: HIJSMM301E1O1S.52.55.E11.1.454.light.4.raw
cgcagtacgacacgaccggtgctcgatttagcactcgcacgttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctc

SEQ ID NO: 543013 - DNA, 485 bp, Homo sapiens
  misc_feature: HIJSMM301B5MXZ.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcgccgaggaccagtggagtcaacgaactgtggctgcaccatctgtctt

SEQ ID NO: 543014 - DNA, 494 bp, Homo sapiens; identical to SEQ ID NO: 540664
  misc_feature: HIJSMM301AGJ1O.47.64.F09.1.454.light.4.raw

SEQ ID NO: 543015 - DNA, 494 bp, Homo sapiens; identical to SEQ ID NO: 534994
  misc_feature: HIJSMM301CJRQP.27.78.H01.1.454.light.4.raw

SEQ ID NO: 543016 - DNA, 495 bp, Homo sapiens
  misc_feature: HIJSMM301CNRTI.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctatcctgcagggccaatcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 543017 - DNA, 485 bp, Homo sapiens; identical to SEQ ID NO: 536576
  misc_feature: HIJSMM301BABNX.46.35.D02.1.454.light.4.raw

SEQ ID NO: 543018 - DNA, 497 bp, Homo sapiens
  misc_feature: HIJSMM301CZKLH.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtctgcagtataataactggcctccacggtacacttttggccgagggaccaagctggagatcaaacgaactgtggctgcaccatctgtt

SEQ ID NO: 543019 - DNA, 487 bp, Homo sapiens; identical to SEQ ID NO: 541729
  misc_feature: HIJSMM301CWR0G.40.83.H06.1.454.light.4.raw

SEQ ID NO: 543020 - DNA, 491 bp, Homo sapiens
  misc_feature: HIJSMM301CDG44.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaacccactgtcactctcg

SEQ ID NO: 543021 - DNA, 507 bp, Homo sapiens
  misc_feature: HIJSMM301DPMVV.40.16.B05.1.454.light.4.raw
tctagcgactcacgaccggtgctcgatttagagctcacgtaagggggtctcaggaggcagcactctcgggacgtctccaccatggcctgggccctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgttcggcggagggaccaagctgaccgtcctaggtcagcccaaggctgccccctcggtcactctgttcccacct

SEQ ID NO: 543022 - DNA, 488 bp, Homo sapiens
  misc_feature: HIJSMM301C1NPL.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccat

SEQ ID NO: 543023 - DNA, 495 bp, Homo sapiens; identical to SEQ ID NO: 542571
  misc_feature: HIJSMM301BJ70R.7.59.F04.1.454.light.4.raw

SEQ ID NO: 543024 - DNA, 486 bp, Homo sapiens; identical to SEQ ID NO: 535290
  misc_feature: HIJSMM301EHB1I.3.12.B01.1.454.light.4.raw

SEQ ID NO: 543025 - DNA, 489 bp, Homo sapiens; identical to SEQ ID NO: 535139
  misc_feature: HIJSMM301CTZWS.14.55.E11.1.454.light.4.raw

SEQ ID NO: 543026 - DNA, 482 bp, Homo sapiens; identical to SEQ ID NO: 535216
  misc_feature: HIJSMM301CF26Q.17.26.C04.1.454.light.4.raw

SEQ ID NO: 543027 - DNA, 447 bp, Homo sapiens; identical to SEQ ID NO: 535020
  misc_feature: HIJSMM301B4UJJ.18.9.A09.1.454.light.4.raw

SEQ ID NO: 543028 - DNA, 475 bp, Homo sapiens
  misc_feature: HIJSMM301BA8KI.41.34.D01.1.454.light.4.raw
tctatactatcacgaccggtgctcgatttagatcgtctgtgttgggtttgggggcaggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggacgggaccgaaggtggaggtcaagcgaa

SEQ ID NO: 543029 - DNA, 493 bp, Homo sapiens; identical to SEQ ID NO: 536769
  misc_feature: HIJSMM301DHT7I.19.83.H06.1.454.light.4.raw

SEQ ID NO: 543030 - DNA, 486 bp, Homo sapiens; identical to SEQ ID NO: 540090
  misc_feature: HIJSMM301C3P1D.17.36.D03.1.454.light.4.raw

SEQ ID NO: 543031 - DNA, 502 bp, Homo sapiens
  misc_feature: HIJSMM301DQNNQ.51.9.A09.1.454.light.4.raw
cgatcgtatacacgaccggtgctcgatttagcgagacgcgcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggatttactcatctctgggctccagtctgaggatgaggctgactattactgtttgatttggcacagcagcgcttgggtattcggcgggggaccgaaactgaccgtcctaggtcagcccaacggctgccccctccggtcc

SEQ ID NO: 543032 - DNA, 494 bp, Homo sapiens
  misc_feature: HIJSMM301AWX1K.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctatcttttctcttcggaactgggaccacggtcaccgtcctaggtcagcccaaggccaaccca

SEQ ID NO: 543033 - DNA, 506 bp, Homo sapiens
  misc_feature: HIJSMM301EKOTF.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgtaccccccacccgtaccggttcggcggacggaccacgacgtcgagactaacaaaacgtaacgtggtggctcgaccaccattcg

SEQ ID NO: 543034 - DNA, 484 bp, Homo sapiens; identical to SEQ ID NO: 535240
  misc_feature: HIJSMM301BOT62.47.60.F05.1.454.light.4.raw

SEQ ID NO: 543035 - DNA, 503 bp, Homo sapiens
  misc_feature: HIJSMM301EM1UY.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatagtcctcctctcacgttcggcggagggaccaaggtggagatacaaacgaactgtggctgcaccatctgtctt

SEQ ID NO: 543036 - DNA, 493 bp, Homo sapiens
  misc_feature: HIJSMM301CM8WN.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 543037 - DNA, 488 bp, Homo sapiens
  misc_feature: HIJSMM301ECQPW.49.12.B01.1.454.light.4.raw
agtcgagagacacgaccggtgctcgatttagtagtgtagattccgcgggcacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagccctaacctcctgatctacgatgcatccaatttggaatagggtcccatcaaggttcagtggaagtggatctgggacgtattttactttctaccatcatcaacctgcagcctgaggatattgcaacatattactgtcaacaatatgataatctaccactcacttcgtcggagggacgacggtgg

SEQ ID NO: 543038 - DNA, 508 bp, Homo sapiens
  misc_feature: HIJSMM301CKF71.16.46.E02.1.454.light.4.raw
tgtactactccacgaccggtgctcgatttagactcatctacaggggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcact

SEQ ID NO: 543039 - DNA, 502 bp, Homo sapiens
  misc_feature: HIJSMM301EG58I.13.53.E09.1.454.light.4.raw
  modified_base (479)..(479): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccgaagaggaagtacaagacgactagtggctgcnccactctgtcttctatcttccgt

SEQ ID NO: 543040 - DNA, 471 bp, Homo sapiens
  misc_feature: HIJSMM301DLGE8.3.38.D05.1.454.light.4.raw
agacgcactccacgaccggtgctcgatttagtatctgatagttgggtttggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaa

SEQ ID NO: 543041 - DNA, 507 bp, Homo sapiens
  misc_feature: HIJSMM301B0GOP.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtggctccggtccgaggatgaggctgattattactgtgcaccgtgggatgacatcctgaatggtccggtgttcggcggagggaccaggctgaccgtcctaagcagcccaaggctgcccccc

SEQ ID NO: 543042 - DNA, 452 bp, Homo sapiens
  misc_feature: HIJSMM301DMUN7.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgagggaccaagctgaccgtcctaagtcagcccaaggctgccccctcggtcactctgttcccgccctcctccacgagagta

SEQ ID NO: 543043 - DNA, 508 bp, Homo sapiens
  misc_feature: HIJSMM301AMSHW.15.59.F04.1.454.light.4.raw
tctacgtagccacgaccggtgctcgatttagtacacacacttagggattggggggaaggcctgagaacacttagccttcatgagtgtccccacccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 543044 - DNA, 446 bp, Homo sapiens
  misc_feature: HIJSMM301CR0EM.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgccctcctcctacgtgagct

SEQ ID NO: 543045 - DNA, 447 bp, Homo sapiens; identical to SEQ ID NO: 535201
  misc_feature: HIJSMM301A54GW.18.9.A09.1.454.light.4.raw

SEQ ID NO: 543046 - DNA, 506 bp, Homo sapiens
  misc_feature: HIJSMM301CJQB1.53.71.G05.1.454.light.4.raw
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctgtt

SEQ ID NO: 543047 - DNA, 475 bp, Homo sapiens
  misc_feature: HIJSMM301DDP9C.52.73.G07.1.454.light.4.raw
cgcagtacgacacgaccggtgctcgatttagctctacgctcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggttattactgcatgcaagttctacaaaatcctcgcacttttggccaggggaccaagctggagatcaaacgaa

SEQ ID NO: 543048 - DNA, 484 bp, Homo sapiens; identical to SEQ ID NO: 535400
  misc_feature: HIJSMM301A0CPM.46.26.C04.1.454.light.4.raw

SEQ ID NO: 543049 - DNA, 504 bp, Homo sapiens
  misc_feature: HIJSMM301DGRWU.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcgccgaaggaccgagggtggaaagtacaaacgaactagtggctgcaccatctgtcttcatcttcccgtccact

SEQ ID NO: 543050 - DNA, 491 bp, Homo sapiens
  misc_feature: HIJSMM301AWMFP.10.72.G06.1.454.light.4.raw
catagtagtgcacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaa

SEQ ID NO: 543051 - DNA, 463 bp, Homo sapiens
  misc_feature: HIJSMM301CPEKC.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttccgccatctgaagtatagtct

SEQ ID NO: 543052 - DNA, 494 bp, Homo sapiens; identical to SEQ ID NO: 535276
  misc_feature: HIJSMM301E3B4V.16.6.A06.1.454.light.4.raw

SEQ ID NO: 543053 - DNA, 513 bp, Homo sapiens
  misc_feature: HIJSMM301AWZZJ.17.33.C11.1.454.light.4.raw
  modified_base (506)..(506): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcct

SEQ ID NO: 543054 - DNA, 485 bp, Homo sapiens; identical to SEQ ID NO: 536576
  misc_feature: HIJSMM301A0TU0.46.35.D02.1.454.light.4.raw

SEQ ID NO: 543055 - DNA, 518 bp, Homo sapiens
  misc_feature: HIJSMM301APFKG.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtttactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctgtt

SEQ ID NO: 543056 - DNA, 505 bp, Homo sapiens
  misc_feature: HIJSMM301EXLXH.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccaccgtcact

SEQ ID NO: 543057 - DNA, 500 bp, Homo sapiens
  misc_feature: HIJSMM301A3ZE4.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactggaccgaaggtcaccgtcctaggtcagcccaaggccaaccccacctgtcactctcgttcccaccctcctccgagtagtaca

SEQ ID NO: 543058 - DNA, 483 bp, Homo sapiens; identical to SEQ ID NO: 535013
  misc_feature: HIJSMM301EIGDT.11.76.G10.1.454.light.4.raw

SEQ ID NO: 543059 - DNA, 520 bp, Homo sapiens; identical to SEQ ID NO: 535773
  misc_feature: HIJSMM301BA98P.41.19.B08.1.454.light.4.raw

SEQ ID NO: 543060 - DNA, 493 bp, Homo sapiens
  misc_feature: HIJSMM301C1M3D.48.1.A01.1.454.light.4.raw
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttccg

SEQ ID NO: 543061 - DNA, 486 bp, Homo sapiens; identical to SEQ ID NO: 535043
  misc_feature: HIJSMM301A5KRF.46.35.D02.1.454.light.4.raw

SEQ ID NO: 543062 - DNA, 503 bp, Homo sapiens
  misc_feature: HIJSMM301BMOZJ.16.49.E05.1.454.light.4.raw
tgtactactccacgaccggtgctcgatttagagcgactagcaacacacaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctccctgacaatctctggcctccaggctgaggacgaggctgattattactgctgctcatattcaagtcgtgtcactatgctttttggcggagggaccaaggtgaccgtcctaggtcagcccaaggctgccccccg

SEQ ID NO: 543063 - DNA, 510 bp, Homo sapiens
  misc_feature: HIJSMM301CM0P5.7.34.D01.1.454.light.4.raw
  modified_base (479)..(479): a, c, t, g, unknown or other
cgtgtctctacacgaccggtgctcgatttagatcgtctgtgttgggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtccngcgtcagcccaaggctgccccctcggtcact

SEQ ID NO: 543064 - DNA, 495 bp, Homo sapiens; identical to SEQ ID NO: 539489
  misc_feature: HIJSMM301CIPGI.51.59.F04.1.454.light.4.raw

SEQ ID NO: 543065 - DNA, 521 bp, Homo sapiens; identical to SEQ ID NO: 538715
  misc_feature: HIJSMM301CEEOT.27.23.C01.1.454.light.4.raw

SEQ ID NO: 543066 - DNA, 479 bp, Homo sapiens; identical to SEQ ID NO: 535118
  misc_feature: HIJSMM301DRN8D.13.59.F04.1.454.light.4.raw

SEQ ID NO: 543067 - DNA, 513 bp, Homo sapiens
  misc_feature: HIJSMM301EGH4K.14.85.H08.1.454.light.4.raw
cgtctagtaccacgaccggtgctcgatttagtatcactcagtcgcgggggggtcgtcaggaggcagcgctctcaggacgtcaccaccatggcctgggctctgctcctcctcagcctcctcactcagggcacagggtccgtgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactcttcg

SEQ ID NO: 543068 - DNA, 496 bp, Homo sapiens
  misc_feature: HIJSMM301DKDL9.12.37.D04.1.454.light.4.raw
  modified_base (366)..(366): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttacccnaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 543069 - DNA, 480 bp, Homo sapiens; identical to SEQ ID NO: 540601
  misc_feature: HIJSMM301CSQ5V.40.21.B10.1.454.light.4.raw

SEQ ID NO: 543070 - DNA, 497 bp, Homo sapiens
  misc_feature: HIJSMM301AX8LX.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctactacttttcggtcgagggaccgaagctggaggatcacaggaaacgtgttggctgcgaccact

SEQ ID NO: 543071 - DNA, 503 bp, Homo sapiens
  misc_feature: HIJSMM301AFU75.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtccttggtc

SEQ ID NO: 543072 - DNA, 447 bp, Homo sapiens; identical to SEQ ID NO: 535201
  misc_feature: HIJSMM301D731Y.18.9.A09.1.454.light.4.raw

SEQ ID NO: 543073 - DNA, 485 bp, Homo sapiens; identical to SEQ ID NO: 535985
  misc_feature: HIJSMM301B7TWE.15.1.A01.1.454.light.4.raw

SEQ ID NO: 543074 - DNA, 486 bp, Homo sapiens; identical to SEQ ID NO: 536555
  misc_feature: HIJSMM301C44X1.26.23.C01.1.454.light.4.raw

SEQ ID NO: 543075 - DNA, 514 bp, Homo sapiens
  misc_feature: HIJSMM301BIV58.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaacggtggaaaagtacaaaacgaaactagtggcgtggcaccatctgtcttcatcttccccg

SEQ ID NO: 543076 - DNA, 508 bp, Homo sapiens; identical to SEQ ID NO: 537871
  misc_feature: HIJSMM301A3AM0.8.33.C11.1.454.light.4.raw

SEQ ID NO: 543077 - DNA, 494 bp, Homo sapiens
  misc_feature: HIJSMM301CTSP3.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgaactgtggctgcaccatctgtcttcat

SEQ ID NO: 543078 - DNA, 441 bp, Homo sapiens
  misc_feature: HIJSMM301AH1GH.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctctgcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 543079 - DNA, 497 bp, Homo sapiens; identical to SEQ ID NO: 535664
  misc_feature: HIJSMM301C4U0A.22.14.B03.1.454.light.4.raw

SEQ ID NO: 543080 - DNA, 459 bp, Homo sapiens; identical to SEQ ID NO: 536529
  misc_feature: HIJSMM301DYMKV.11.86.H09.1.454.light.4.raw

SEQ ID NO: 543081 - DNA, 509 bp, Homo sapiens
  misc_feature: HIJSMM301EAPLS.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcattttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaagtcagcccaaggctgccccctcggtcactctgttccca

SEQ ID NO: 543082 - DNA, 490 bp, Homo sapiens
  misc_feature: HIJSMM301CMUAZ.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttatactgtcagcagcgtagcaactggcctcggacgttcggccaagggaccaaagtggacatcaagcgaactgtggctgcaccatctgtt

SEQ ID NO: 543083 - DNA, 442 bp, Homo sapiens
  misc_feature: HIJSMM301BUZQD.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggaccccacgtaaccgtcctaggtcagcccaaggctgccccctcggtcactctgttcccaccctcctcgtatctctcg

SEQ ID NO: 543084 - DNA, 444 bp, Homo sapiens; identical to SEQ ID NO: 538511
  misc_feature: HIJSMM301AJWCC.5.9.A09.1.454.light.4.raw
  modified_base (426)..(426): a, c, t, g, unknown or other

SEQ ID NO: 543085 - DNA, 494 bp, Homo sapiens; identical to SEQ ID NO: 537607
  misc_feature: HIJSMM301DCCH7.52.10.A10.1.454.light.4.raw

SEQ ID NO: 543086 - DNA, 486 bp, Homo sapiens; identical to SEQ ID NO: 537144
  misc_feature: HIJSMM301DYFGH.46.35.D02.1.454.light.4.raw

SEQ ID NO: 543087 - DNA, 525 bp, Homo sapiens
  misc_feature: HIJSMM301EPKNE.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccagatgaagtctggccaggcccccaggacactaatttatgatgcgaccaacagacactcctgggcgcctggccgtttttcgggctccctcctcggggcaaagctgccctgaccctaacggggcgcagcctgaggacgaggccgactattattgcctactatcatttgatggtggtcgtctgcccattttcggcggcgggaccagggtgggccgtcctgggtcagcccaaggctgccccctcggtcactctgttcccaccctcctcctagtctacg

SEQ ID NO: 543088 - DNA, 480 bp, Homo sapiens
  misc_feature: HIJSMM301AZHE9.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgctggttttggctgttcggcggcgggacc

SEQ ID NO: 543089 - DNA, 447 bp, Homo sapiens; identical to SEQ ID NO: 535020
  misc_feature: HIJSMM301CFEUB.18.9.A09.1.454.light.4.raw

SEQ ID NO: 543090 - DNA, 509 bp, Homo sapiens; identical to SEQ ID NO: 535670
  misc_feature: HIJSMM301BUP5V.47.23.C01.1.454.light.4.raw

SEQ ID NO: 543091 - DNA, 490 bp, Homo sapiens; identical to SEQ ID NO: 535234
  misc_feature: HIJSMM301E1INX.17.21.B10.1.454.light.4.raw

SEQ ID NO: 543092 - DNA, 477 bp, Homo sapiens
  misc_feature: HIJSMM301EWFN6.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcggggggaccgaacggtggaggatcaaacgaact

SEQ ID NO: 543093 - DNA, 448 bp, Homo sapiens; identical to SEQ ID NO: 534998
  misc_feature: HIJSMM301CXVLJ.18.9.A09.1.454.light.4.raw

SEQ ID NO: 543094 - DNA, 495 bp, Homo sapiens
  misc_feature: HIJSMM301D527C.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 543095 - DNA, 486 bp, Homo sapiens; identical to SEQ ID NO: 537144
  misc_feature: HIJSMM301DIQRS.46.35.D02.1.454.light.4.raw

SEQ ID NO: 543096 - DNA, 491 bp, Homo sapiens; identical to SEQ ID NO: 537135
  misc_feature: HIJSMM301BA1KM.21.46.E02.1.454.light.4.raw

SEQ ID NO: 543097 - DNA, 508 bp, Homo sapiens
  misc_feature: HIJSMM301CHTI0.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccgaacgtggaaatcaaacgaactgtggctgcaccatctgtcttcta

SEQ ID NO: 543098 - DNA, 499 bp, Homo sapiens
  misc_feature: HIJSMM301CHZI0.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaa

SEQ ID NO: 543099 - DNA, 497 bp, Homo sapiens; identical to SEQ ID NO: 535664
  misc_feature: HIJSMM301B1L77.22.14.B03.1.454.light.4.raw

SEQ ID NO: 543100 - DNA, 514 bp, Homo sapiens
  misc_feature: HIJSMM301CR5CO.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccaccctcctcga

SEQ ID NO: 543101 - DNA, 488 bp, Homo sapiens; identical to SEQ ID NO: 537260
  misc_feature: HIJSMM301AYM4K.47.70.G04.1.454.light.4.raw

SEQ ID NO: 543102 - DNA, 512 bp, Homo sapiens
  misc_feature: HIJSMM301EVQNL.18.26.C04.1.454.light.4.raw
tacgagtatgcacgaccggtgctcgatttagtctagcgactttggggtttgggggggtcgagacccacgtcgggacgacagcatggacatgagggtccccggcctcagctcctggggcgtcctgctgctctggttcccacggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagattttcactctcaccatcacccagcctgcagcctgaagattttgcaacttactattgtcaacaggctgacaggttcccgctgactttggcggagggaccaaggtagagatcaaaggaactgtggctgcaccatctgtcttcatctttccccgcca

SEQ ID NO: 543103 - DNA, 505 bp, Homo sapiens
  misc_feature: HIJSMM301DZQ4U.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactgtggctgcaccatctgtcttc

SEQ ID NO: 543104 - DNA, 447 bp, Homo sapiens; identical to SEQ ID NO: 535201
  misc_feature: HIJSMM301ASTFO.18.9.A09.1.454.light.4.raw

SEQ ID NO: 543105 - DNA, 490 bp, Homo sapiens; identical to SEQ ID NO: 541141
  misc_feature: HIJSMM301DQ5Z1.47.38.D05.1.454.light.4.raw

SEQ ID NO: 543106 - DNA, 491 bp, Homo sapiens
  misc_feature: HIJSMM301CTR7Q.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggcggagatcagacgaactgtggcgtgcaccatctgtcttcta

SEQ ID NO: 543107 - DNA, 493 bp, Homo sapiens; identical to SEQ ID NO: 542591
  misc_feature: HIJSMM301CIIVJ.9.1.A01.1.454.light.4.raw

SEQ ID NO: 543108 - DNA, 486 bp, Homo sapiens; identical to SEQ ID NO: 535458
  misc_feature: HIJSMM301DUMB1.7.75.G09.1.454.light.4.raw

SEQ ID NO: 543109 - DNA, 503 bp, Homo sapiens
  misc_feature: HIJSMM301C5TBP.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaacccactgtca

SEQ ID NO: 543110 - DNA, 475 bp, Homo sapiens
  misc_feature: HIJSMM301AZS9W.3.1.A01.1.454.light.4.raw
agacgcactccacgaccggtgctcgatttagacgtctcatcaggggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcaccat

SEQ ID NO: 543111 - DNA, 354 bp, Homo sapiens; identical to SEQ ID NO: 535026
  misc_feature: HIJSMM301BMKTV.19.22.B11.1.454.light.4.raw

SEQ ID NO: 543112 - DNA, 476 bp, Homo sapiens
  misc_feature: HIJSMM301DSTAZ.17.29.C07.1.454.light.4.raw
cgtagactagcacgaccggtgctcgatttagagtgctacgaagggaaagggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcctagtctacg

SEQ ID NO: 543113 - DNA, 490 bp, Homo sapiens; identical to SEQ ID NO: 537658
  misc_feature: HIJSMM301BYTO3.14.55.E11.1.454.light.4.raw

SEQ ID NO: 543114 - DNA, 493 bp, Homo sapiens; identical to SEQ ID NO: 537912
  misc_feature: HIJSMM301CZ8T4.13.46.E02.1.454.light.4.raw

SEQ ID NO: 543115 - DNA, 506 bp, Homo sapiens
  misc_feature: HIJSMM301ERC2V.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtatcactcggcgtggtacgttcggaccgaacgggaaccgaaggtaggaatacgaaacgaactgtggcgtgcacc

SEQ ID NO: 543116 - DNA, 499 bp, Homo sapiens
  misc_feature: HIJSMM301C0NV7.18.23.C01.1.454.light.4.raw
tacgagtatgcacgaccggtgctcgatttagtacacgtgattagggattgggggcaggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcacttttcggcggagggaccaaggtggagatcaaacgaactgtggctgcaccatctgtcttcta

SEQ ID NO: 543117 - DNA, 483 bp, Homo sapiens
  misc_feature: HIJSMM301BNNXR.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccagggggaccaggctggagatcaaacgaa

SEQ ID NO: 543118 - DNA, 503 bp, Homo sapiens; identical to SEQ ID NO: 536450
  misc_feature: HIJSMM301ETCSD.48.78.H01.1.454.light.4.raw

SEQ ID NO: 543119 - DNA, 475 bp, Homo sapiens
  misc_feature: HIJSMM301CTBS4.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcgcggagggaccgaaggtggagat

SEQ ID NO: 543120 - DNA, 510 bp, Homo sapiens
  misc_feature: HIJSMM301AWC2Y.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgccaatgtgcacgcaagcgggacccagaccctggagcctcagttggaagcagccgatccagcctgcggagcctgtgggcaggtcagcccaaggctgccccctcggtcactctcgttcccaccctcctcacg

SEQ ID NO: 543121 - DNA, 485 bp, Homo sapiens; identical to SEQ ID NO: 541838
  misc_feature: HIJSMM301CGPJZ.22.6.A06.1.454.light.4.raw

SEQ ID NO: 543122 - DNA, 508 bp, Homo sapiens; identical to SEQ ID NO: 536388
  misc_feature: HIJSMM301ECQSF.11.57.F02.1.454.light.4.raw

SEQ ID NO: 543123 - DNA, 488 bp, Homo sapiens; identical to SEQ ID NO: 536861
  misc_feature: HIJSMM301AKYQU.12.88.H11.1.454.light.4.raw

SEQ ID NO: 543124 - DNA, 480 bp, Homo sapiens
  misc_feature: HIJSMM301B6R36.41.12.B01.1.454.light.4.raw
tctatactatcacgaccggtgctcgatttagtagtgtagattccgcggggaggaatcagacccagtcaggacacagcatggacatgagagtcctcgctcagctcctggggctcctgctgctctgtttcccaggtgccagatgtgacatccagatgacccagtctccgtcctcactgtctgcatctgtgggagacagagtcaccatcacttgtcgggcgagtcaggacattagcaattatttagcctggtttcagcagaaacccggcaacgcccctaaatccctaatctatgctgcatccactttgcgaagtgggtcccgtcaaagttcagcggcggcagatctgggacagacttcactctcaccatcagcaacctgcagcctgaagattttgcaacttattactgccaacaatacagcacgtttcccctcactttcggcggaggaccaggtggagatcaaacgaactgtggctgcaccat

SEQ ID NO: 543125 - DNA, 512 bp, Homo sapiens
  misc_feature: HIJSMM301EBZ6M.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtggaaagtacaaacgaactagtggctgcaccactctgtcttcatcttcccgccta

SEQ ID NO: 543126 - DNA, 505 bp, Homo sapiens; identical to SEQ ID NO: 535503
  misc_feature: HIJSMM301A5JP7.8.28.C06.1.454.light.4.raw

SEQ ID NO: 543127 - DNA, 494 bp, Homo sapiens; identical to SEQ ID NO: 534992
  misc_feature: HIJSMM301DZX7F.9.1.A01.1.454.light.4.raw

SEQ ID NO: 543128 - DNA, 443 bp, Homo sapiens
  misc_feature: HIJSMM301DL5RC.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgcccctcggtcactctgttcccgccctcctccgtgtctgat

SEQ ID NO: 543129 - DNA, 498 bp, Homo sapiens; identical to SEQ ID NO: 538749
  misc_feature: HIJSMM301CCD2M.43.34.D01.1.454.light.4.raw

SEQ ID NO: 543130 - DNA, 445 bp, Homo sapiens; identical to SEQ ID NO: 542143
  misc_feature: HIJSMM301B6ZUL.47.85.H08.1.454.light.4.raw

SEQ ID NO: 543131 - DNA, 517 bp, Homo sapiens
  misc_feature: HIJSMM301DTWCA.12.71.G05.1.454.light.4.raw
atacgacgtacacgaccggtgctcgatttagtgtcgtcgcaagagagaggggagtgaggagcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggcggattattactgttgctcatatgcgggtagtagcactttcgatgtcctattcggcggagggaccaagctgaccgtcctggtcagcccaaggctgccccctcggtcactctgttccccg

SEQ ID NO: 543132 - DNA, 502 bp, Homo sapiens
  misc_feature: HIJSMM301EWCC9.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctg

SEQ ID NO: 543133 - DNA, 481 bp, Homo sapiens
  misc_feature: HIJSMM301CD79U.41.8.A08.1.454.light.4.raw
tctatactatcacgaccggtgctcgatttagcatactctacaggggggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatagaccgtcggccaacgggacaacgactggacattaaacgaaactgtgctgcaccat

SEQ ID NO: 543134 - DNA, 487 bp, Homo sapiens
  misc_feature: HIJSMM301C1627.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaacggaccgaagtgggatatcagacgaa

SEQ ID NO: 543135 - DNA, 497 bp, Homo sapiens
  misc_feature: HIJSMM301A3CHM.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggcccatcaaggttcagtggcagtggctctgggacagatttcactctcaccatcagcagtctccaacctgaagattttgcaacttactactgtcaacagagtttcagtagtccccggacgtcggtccaggacgaacggtggacgatacaacgaacctagtaggcgtgcaccaactctgtcttt

SEQ ID NO: 543136 - DNA, 464 bp, Homo sapiens; identical to SEQ ID NO: 536640
  misc_feature: HIJSMM301AN8XE.26.78.H01.1.454.light.4.raw

SEQ ID NO: 543137 - DNA, 487 bp, Homo sapiens
  misc_feature: HIJSMM301D112E.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagacccg

SEQ ID NO: 543138 - DNA, 507 bp, Homo sapiens
  misc_feature: HIJSMM301EWTWO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcacggacgaacggtaggagtacaacgaactagtggctgcaccactctgtcttctatcttcccgtcccact

SEQ ID NO: 543139 - DNA, 499 bp, Homo sapiens; identical to SEQ ID NO: 537739
  misc_feature: HIJSMM301C26OM.12.86.H09.1.454.light.4.raw

SEQ ID NO: 543140 - DNA, 468 bp, Homo sapiens
  misc_feature: HIJSMM301BNEY2.48.58.F03.1.454.light.4.raw
agtatacatacacgaccggtgctcgatttagtctgatcgagaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggaggaccaag

SEQ ID NO: 543141 - DNA, 504 bp, Homo sapiens; identical to SEQ ID NO: 539091
  misc_feature: HIJSMM301BZB58.8.28.C06.1.454.light.4.raw

SEQ ID NO: 543142 - DNA, 506 bp, Homo sapiens; identical to SEQ ID NO: 534969
  misc_feature: HIJSMM301DCUJS.18.37.D04.1.454.light.4.raw

SEQ ID NO: 543143 - DNA, 494 bp, Homo sapiens; identical to SEQ ID NO: 534994
  misc_feature: HIJSMM301AOA2C.27.78.H01.1.454.light.4.raw

SEQ ID NO: 543144 - DNA, 506 bp, Homo sapiens
  misc_feature: HIJSMM301CZ90N.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcta

SEQ ID NO: 543145 - DNA, 454 bp, Homo sapiens; identical to SEQ ID NO: 534964
  misc_feature: HIJSMM301BFOOQ.19.86.H09.1.454.light.4.raw

SEQ ID NO: 543146 - DNA, 503 bp, Homo sapiens; identical to SEQ ID NO: 539976
  misc_feature: HIJSMM301EWFVH.47.55.E11.1.454.light.4.raw

SEQ ID NO: 543147 - DNA, 516 bp, Homo sapiens
  misc_feature: HIJSMM301BHKU4.7.86.H09.1.454.light.4.raw
  modified_base (389)..(389): a, c, t, g, unknown or other
cgtgtctctacacgaccggtgctcgatttagtgctatagacttggggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagtcaccctctcctgcagggccagtgaaccttttagtagtagttatttagcctggtatcggcaaaacctggccaggctccccgactcctcttctttggtggagcctacagggccactggcaccccagacaggatcagtggcagcgggtctgggacagacttcattctcaccatcaacngactgcagcctgaagatattgcagtttactactgtcagcagtatgttacgtcccgtggacttcggccaagggaccaaggtggcaatcaaccgaactgtggctgcaccatctgtcttcatcttccccg

SEQ ID NO: 543148 - DNA, 485 bp, Homo sapiens
  misc_feature: HIJSMM301EUREZ.5.34.D01.1.454.light.4.raw
atcagacacgcacgaccggtgctcgatttagatcgtctgtgttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagttttccctccgaccttcggccaacggacacgactggagataaacgaactagtggctgcgacca

SEQ ID NO: 543149 - DNA, 496 bp, Homo sapiens
  misc_feature: HIJSMM301D5UHA.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaatcaaacgaaactgtggctgcaccatctgtctt

SEQ ID NO: 543150 - DNA, 506 bp, Homo sapiens; identical to SEQ ID NO: 542696
  misc_feature: HIJSMM301AU68U.7.71.G05.1.454.light.4.raw

SEQ ID NO: 543151 - DNA, 503 bp, Homo sapiens; identical to SEQ ID NO: 536834
  misc_feature: HIJSMM301AXIS1.2.35.D02.1.454.light.4.raw

SEQ ID NO: 543152 - DNA, 444 bp, Homo sapiens; identical to SEQ ID NO: 535027
  misc_feature: HIJSMM301B2EGT.8.73.G07.1.454.light.4.raw

SEQ ID NO: 543153 - DNA, 484 bp, Homo sapiens; identical to SEQ ID NO: 536353
  misc_feature: HIJSMM301AQJT0.52.53.E09.1.454.light.4.raw

SEQ ID NO: 543154 - DNA, 495 bp, Homo sapiens; identical to SEQ ID NO: 535007
  misc_feature: HIJSMM301A58VJ.22.5.A05.1.454.light.4.raw

SEQ ID NO: 543155 - DNA, 492 bp, Homo sapiens
  misc_feature: HIJSMM301ASKQM.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgtgg

SEQ ID NO: 543156 - DNA, 505 bp, Homo sapiens
  misc_feature: HIJSMM301CDABK.21.22.B11.1.454.light.4.raw
tcgtcgctcgcacgaccggtgctcgatttagacgacagctcagggtggggtcaaaaacccggggagggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggcctcaggggtccctgaccgattctctggctccaagtctggcacctcagcctccctgaccatcagtgggctccggtccgaggatgaggctgactattact

SEQ ID NO: 543157 - DNA, 447 bp, Homo sapiens; identical to SEQ ID NO: 535201
  misc_feature: HIJSMM301A823W.18.9.A09.1.454.light.4.raw

SEQ ID NO: 543158 - DNA, 497 bp, Homo sapiens; identical to SEQ ID NO: 535664
  misc_feature: HIJSMM301BV5YB.22.14.B03.1.454.light.4.raw

SEQ ID NO: 543159 - DNA, 519 bp, Homo sapiens
  misc_feature: HIJSMM301DQIQL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgtcccgcct

SEQ ID NO: 543160 - DNA, 495 bp, Homo sapiens; identical to SEQ ID NO: 543094
  misc_feature: HIJSMM301C4VYX.22.57.F02.1.454.light.4.raw

SEQ ID NO: 543161 - DNA, 443 bp, Homo sapiens
  misc_feature: HIJSMM301B0TXO.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtctaagtcagcccaaggctgccccctcggtcactctgttcccaccctcctccgtgtctgat

SEQ ID NO: 543162 - DNA, 497 bp, Homo sapiens; identical to SEQ ID NO: 535286
  misc_feature: HIJSMM301BOSX2.18.59.F04.1.454.light.4.raw

SEQ ID NO: 543163 - DNA, 479 bp, Homo sapiens; identical to SEQ ID NO: 538734
  misc_feature: HIJSMM301CD79X.8.53.E09.1.454.light.4.raw

SEQ ID NO: 543164 - DNA, 492 bp, Homo sapiens
  misc_feature: HIJSMM301DQQFF.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccagacaccctgtctttgtctccaggagagagggccaccctctcctgcagggccagtcagaatattacctcttacctggcctggtaccaacaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaacgaactgtggctgcaccatctgtcttcatcttcccgccat

SEQ ID NO: 543165 - DNA, 419 bp, Homo sapiens
  misc_feature: HIJSMM301BYZ0U.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 543166 - DNA, 487 bp, Homo sapiens
  misc_feature: HIJSMM301AOE85.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccat

SEQ ID NO: 543167 - DNA, 485 bp, Homo sapiens
  misc_feature: HIJSMM301EJ6R3.49.33.C11.1.454.light.4.raw
agtcgagagacacgaccggtgctcgatttagagtgagctcgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtatggcacttctgtcgtattcggcggagggaccaagctgaccgtcctaggtcagcccaaggctcg

SEQ ID NO: 543168 - DNA, 498 bp, Homo sapiens
  misc_feature: HIJSMM301AR9UF.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacca

SEQ ID NO: 543169 - DNA, 483 bp, Homo sapiens
  misc_feature: HIJSMM301AXVXV.48.5.A05.1.454.light.4.raw
  modified_base (471)..(471): a, c, t, g, unknown or other
agtatacatacacgaccggtgctcgatttagatagatagacaggggggaggtcagacccacgtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggtccaagggaccgaaggtggaatacaaacgaaactntggctgcaccat

SEQ ID NO: 543170 - DNA, 501 bp, Homo sapiens; identical to SEQ ID NO: 540528
  misc_feature: HIJSMM301B0NMI.11.31.C09.1.454.light.4.raw

SEQ ID NO: 543171 - DNA, 520 bp, Homo sapiens
  misc_feature: HIJSMM301AITKS.48.24.C02.1.454.light.4.raw
agtatacatacacgaccggtgctcgatttagtacagatcgttagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgccct

SEQ ID NO: 543172 - DNA, 502 bp, Homo sapiens
  misc_feature: HIJSMM301A6FX9.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccca

SEQ ID NO: 543173 - DNA, 504 bp, Homo sapiens
  misc_feature: HIJSMM301D5CXY.41.35.D02.1.454.light.4.raw
tctatactatcacgaccggtgctcgatttagcacacgatagttgggtttgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 543174 - DNA, 503 bp, Homo sapiens
  misc_feature: HIJSMM301AM7MZ.47.83.H06.1.454.light.4.raw
agctcacgtacacgaccggtgctcgatttagatcacgtgcgtcgcggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggaggaccaagctgaccgtcg

SEQ ID NO: 543175 - DNA, 491 bp, Homo sapiens
  misc_feature: HIJSMM301BS88U.5.57.F02.1.454.light.4.raw
  modified_base (455)..(455): a, c, t, g, unknown or other
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtggtcagtggcctcgaacgttcgcccagggaccacagnggatatcaggcgaactgtggctgcaccatctgtctt

SEQ ID NO: 543176 - DNA, 444 bp, Homo sapiens
  misc_feature: HIJSMM301A45BU.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtcactgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctccactactatg

SEQ ID NO: 543177 - DNA, 504 bp, Homo sapiens; identical to SEQ ID NO: 534983
  misc_feature: HIJSMM301BMPSV.9.12.B01.1.454.light.4.raw

SEQ ID NO: 543178 - DNA, 467 bp, Homo sapiens
  misc_feature: HIJSMM301EWLOF.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgcccccgctccagtttcggcggagggaccaaggtggagatac

SEQ ID NO: 543179 - DNA, 488 bp, Homo sapiens; identical to SEQ ID NO: 537260
  misc_feature: HIJSMM301EJ307.47.70.G04.1.454.light.4.raw

SEQ ID NO: 543180 - DNA, 485 bp, Homo sapiens
  misc_feature: HIJSMM301B228Z.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccc

SEQ ID NO: 543181 - DNA, 497 bp, Homo sapiens
  misc_feature: HIJSMM301CMW45.13.11.A11.1.454.light.4.raw
tcacgtactacacgaccggtgctcgatttagctacgactgcagggggaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacactttggtccgacgggaccgaagactggagatcaagcgaactgtggctgcaccactctcgtcttctat

SEQ ID NO: 543182 - DNA, 494 bp, Homo sapiens; identical to SEQ ID NO: 539065
  misc_feature: HIJSMM301CWNC6.11.81.H04.1.454.light.4.raw

SEQ ID NO: 543183 - DNA, 480 bp, Homo sapiens
  misc_feature: HIJSMM301A66ZQ.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcagggtccctgaccgattctctggctccaagtctggcacctcagcctccctggtcatcgctgggctccaggctgacgatgaggctgattattattgccagtcctatgacaacaccctgcgtggttttggctgttcggcggcgggacc

SEQ ID NO: 543184 - DNA, 492 bp, Homo sapiens; identical to SEQ ID NO: 541936
  misc_feature: HIJSMM301D4H3I.47.78.H01.1.454.light.4.raw

SEQ ID NO: 543185 - DNA, 480 bp, Homo sapiens; identical to SEQ ID NO: 535442
  misc_feature: HIJSMM301EDDS3.41.17.B06.1.454.light.4.raw

SEQ ID NO: 543186 - DNA, 510 bp, Homo sapiens
  misc_feature: HIJSMM301D42NR.8.28.C06.1.454.light.4.raw
ctcgcgtgtccacgaccggtgctcgatttagagctcacgtattggggtttggggaggaactgctcagttaggacccacgacggaaccatggaagccccacgcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctagccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaaactgtggctgcaccatctgtcttcatcttcccgccat

SEQ ID NO: 543187 - DNA, 485 bp, Homo sapiens; identical to SEQ ID NO: 536040
  misc_feature: HIJSMM301CGC3P.15.1.A01.1.454.light.4.raw

SEQ ID NO: 543188 - DNA, 498 bp, Homo sapiens
  misc_feature: HIJSMM301BZXBU.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttccccg

SEQ ID NO: 543189 - DNA, 493 bp, Homo sapiens
  misc_feature: HIJSMM301CT9WE.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgatacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggatttcagacgaactgtggctgcaccatctgtctt

SEQ ID NO: 543190 - DNA, 504 bp, Homo sapiens
  misc_feature: HIJSMM301CMOIJ.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaaggctgaccgtcctaagtcagcccaaggctgccccctcggtcact

SEQ ID NO: 543191 - DNA, 485 bp, Homo sapiens
  misc_feature: HIJSMM301DAU78.52.34.D01.1.454.light.4.raw
cgcagtacgacacgaccggtgctcgatttagatcgtctgtgttgggtttggggagagctctggggagtctgcaccatggctaggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 543192 - DNA, 495 bp, Homo sapiens
  misc_feature: HIJSMM301B5Y7T.19.15.B04.1.454.light.4.raw
  modified_base (489)..(489): a, c, t, g, unknown or other
tactctcgtgcacgaccggtgctcgatttagacagtatatatccgcggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccatcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccatntccccg

SEQ ID NO: 543193 - DNA, 505 bp, Homo sapiens; identical to SEQ ID NO: 536117
  misc_feature: HIJSMM301ED8UJ.8.71.G05.1.454.light.4.raw

SEQ ID NO: 543194 - DNA, 506 bp, Homo sapiens; identical to SEQ ID NO: 536355
  misc_feature: HIJSMM301DJFKT.47.85.H08.1.454.light.4.raw

SEQ ID NO: 543195 - DNA, 490 bp, Homo sapiens
  misc_feature: HIJSMM301A3JME.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacagactctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtca

SEQ ID NO: 543196 - DNA, 503 bp, Homo sapiens; identical to SEQ ID NO: 536760
  misc_feature: HIJSMM301EZBU4.47.55.E11.1.454.light.4.raw

SEQ ID NO: 543197 - DNA, 507 bp, Homo sapiens
  misc_feature: HIJSMM301C8E08.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcgcccgggggaccaaagtggaaatcaaacgaactgtggctgcaccatctgtcttcatcttcccgcc

SEQ ID NO: 543198 - DNA, 350 bp, Homo sapiens; identical to SEQ ID NO: 537421
  misc_feature: HIJSMM301BNNXN.13.11.A11.1.454.light.4.raw

SEQ ID NO: 543199 - DNA, 484 bp, Homo sapiens; identical to SEQ ID NO: 535441
  misc_feature: HIJSMM301DL2AY.26.60.F05.1.454.light.4.raw

SEQ ID NO: 543200 - DNA, 497 bp, Homo sapiens
  misc_feature: HIJSMM301B6SEA.43.53.E09.1.454.light.4.raw
tgtgagtagtcacgaccggtgctcgatttagagagagtgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccca

SEQ ID NO: 543201 - DNA, 440 bp, Homo sapiens
  misc_feature: HIJSMM301AXCZN.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctggtcactctgttcccgccctcctcgtatctctcg

SEQ ID NO: 543202 - DNA, 500 bp, Homo sapiens
  misc_feature: HIJSMM301B8VNC.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtctaggtcagcccaaggctgccccctc

SEQ ID NO: 543203 - DNA, 462 bp, Homo sapiens
  misc_feature: HIJSMM301COKG2.49.76.G10.1.454.light.4.raw
agtcgagagacacgaccggtgctcgatttagtcactcatacaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgtgg

SEQ ID NO: 543204 - DNA, 486 bp, Homo sapiens; identical to SEQ ID NO: 535043
  misc_feature: HIJSMM301AN6YL.46.35.D02.1.454.light.4.raw

SEQ ID NO: 543205 - DNA, 493 bp, Homo sapiens
  misc_feature: HIJSMM301BR7AM.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 543206 - DNA, 502 bp, Homo sapiens
  misc_feature: HIJSMM301A8V16.48.35.D02.1.454.light.4.raw
agtatacatacacgaccggtgctcgatttagcacacgatagttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctc

SEQ ID NO: 543207 - DNA, 501 bp, Homo sapiens
  misc_feature: HIJSMM301BRB1S.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 543208 - DNA, 454 bp, Homo sapiens; identical to SEQ ID NO: 535005
  misc_feature: HIJSMM301DLNES.19.86.H09.1.454.light.4.raw

SEQ ID NO: 543209 - DNA, 501 bp, Homo sapiens
  misc_feature: HIJSMM301EUH99.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 543210 - DNA, 457 bp, Homo sapiens
  misc_feature: HIJSMM301DDBFY.11.86.H09.1.454.light.4.raw
cgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtgttttcggcgagggaccaagctgaccgtcctaggtcagcccaaggctgccccctcggtcactctgttcccgccctcctcgtatctctcg

SEQ ID NO: 543211 - DNA, 494 bp, Homo sapiens
  misc_feature: HIJSMM301C5S1Q.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccgaaagtaggacgatcaagacgaactagtggctgcaccatct

SEQ ID NO: 543212 - DNA, 486 bp, Homo sapiens
  misc_feature: HIJSMM301BHN5Z.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatactgtatgcaaggtatagagcttcctccgacgttcggccaagggaccaaggtggaactcaaacgaa

SEQ ID NO: 543213 - DNA, 445 bp, Homo sapiens; identical to SEQ ID NO: 537719
  misc_feature: HIJSMM301D6YMP.47.85.H08.1.454.light.4.raw

SEQ ID NO: 543214 - DNA, 443 bp, Homo sapiens; identical to SEQ ID NO: 535475
  misc_feature: HIJSMM301BH5SJ.8.73.G07.1.454.light.4.raw

SEQ ID NO: 543215 - DNA, 497 bp, Homo sapiens
  misc_feature: HIJSMM301BY8YS.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccaggtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagtattttacactagaaaatcaacagagtggaggctgaggatggttggggtttattactgcatgcaagctctacaaactccctcaacgttcggcggagggaccaaggtggagatacaaacgaactgtggctgcacatctgtcttcta

SEQ ID NO: 543216 - DNA, 486 bp, Homo sapiens; identical to SEQ ID NO: 535043
  misc_feature: HIJSMM301EBGMN.46.35.D02.1.454.light.4.raw

SEQ ID NO: 543217 - DNA, 447 bp, Homo sapiens; identical to SEQ ID NO: 535020
  misc_feature: HIJSMM301DM0A2.18.9.A09.1.454.light.4.raw

SEQ ID NO: 543218 - DNA, 481 bp, Homo sapiens; identical to SEQ ID NO: 540702
  misc_feature: HIJSMM301DKHY4.13.8.A08.1.454.light.4.raw

SEQ ID NO: 543219 - DNA, 471 bp, Homo sapiens; identical to SEQ ID NO: 537461
  misc_feature: HIJSMM301CMAPX.7.81.H04.1.454.light.4.raw

SEQ ID NO: 543220 - DNA, 501 bp, Homo sapiens
  misc_feature: HIJSMM301ELPZC.41.87.H10.1.454.light.4.raw
tctatactatcacgaccggtgctcgatttagcagtactgcgttgggtttggggactttgcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggcccttcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccacctcctcatagtatga

SEQ ID NO: 543221 - DNA, 522 bp, Homo sapiens
  misc_feature: HIJSMM301B877B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacggaccgaacggtaggaaagtacgaaacgaaaccgtagtggcgtcggcacccaatcctgtcttctacttctttccccg

SEQ ID NO: 543222 - DNA, 485 bp, Homo sapiens
  misc_feature: HIJSMM301A45B3.52.22.B11.1.454.light.4.raw
cgcagtacgacacgaccggtgctcgatttagacgacagctcaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtctt

SEQ ID NO: 543223 - DNA, 497 bp, Homo sapiens
  misc_feature: HIJSMM301CHM34.43.39.D06.1.454.light.4.raw
tgtgagtagtcacgaccggtgctcgatttagtgacatctcgcagttctttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 543224 - DNA, 453 bp, Homo sapiens
  misc_feature: HIJSMM301BWOTY.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccgccctcctcacgagagta

SEQ ID NO: 543225 - DNA, 496 bp, Homo sapiens
  misc_feature: HIJSMM301BI6E6.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcact

SEQ ID NO: 543226 - DNA, 466 bp, Homo sapiens; identical to SEQ ID NO: 535366
  misc_feature: HIJSMM301ECBW6.13.4.A04.1.454.light.4.raw

SEQ ID NO: 543227 - DNA, 515 bp, Homo sapiens
  misc_feature: HIJSMM301EA7NR.49.11.A11.1.454.light.4.raw
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccaccctcctctctctcg

SEQ ID NO: 543228 - DNA, 510 bp, Homo sapiens
  misc_feature: HIJSMM301C1WB3.43.48.E04.1.454.light.4.raw
tgtgagtagtcacgaccggtgctcgatttagagagcgtcacagagagaaggggctgggcctcaggaagcagcatcgggggtgccgcagccatggcctggaccgctctccttctgagcctccttgctcactttacagagtctgtggcctcctacgagctgactcagccaccctcagtgtcagtggccctgggacaggcggccaggataacctgtgggggacacaatattgcagataagagtgtccactggtatcaccagaagcccggccaggcccctgtattggtcatctacagagacaccagccggcccgctgggatccctgagcgattctctgcctccaactcggggaacacggccaccctgaccatcagcagagcccaagtcggggatgagggtgactattactgtcaagtgtgggacaagagcactgtgattttcggcggaggggccaagttgaccgttttaggtcagcccaaggctcgccccctcggtcactctcgttcccgccct

SEQ ID NO: 543229 - DNA, 503 bp, Homo sapiens
  misc_feature: HIJSMM301EXC3P.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattacactgctgctcatatgcaggtcgtatctcttatgtcttcggaactgggaccaaggtcaccgtcctaggtcagcccaaggcccaacccactgtcta

SEQ ID NO: 543230 - DNA, 506 bp, Homo sapiens
  misc_feature: HIJSMM301ESPXQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaatcaaacgaactacgtggctgcaccactctgtcttcatcttccccg

SEQ ID NO: 543231 - DNA, 503 bp, Homo sapiens
  misc_feature: HIJSMM301BWJWT.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctggtcta

SEQ ID NO: 543232 - DNA, 494 bp, Homo sapiens; identical to SEQ ID NO: 534992
  misc_feature: HIJSMM301BVAX4.9.1.A01.1.454.light.4.raw

SEQ ID NO: 543233 - DNA, 484 bp, Homo sapiens; identical to SEQ ID NO: 535400
  misc_feature: HIJSMM301CENR7.46.26.C04.1.454.light.4.raw

SEQ ID NO: 543234 - DNA, 499 bp, Homo sapiens
  misc_feature: HIJSMM301BEFFD.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttacttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccct

SEQ ID NO: 543235 - DNA, 484 bp, Homo sapiens; identical to SEQ ID NO: 539370
  misc_feature: HIJSMM301A3NQ9.22.73.G07.1.454.light.4.raw

SEQ ID NO: 543236 - DNA, 497 bp, Homo sapiens; identical to SEQ ID NO: 535286
  misc_feature: HIJSMM301BDUW0.18.59.F04.1.454.light.4.raw

SEQ ID NO: 543237 - DNA, 484 bp, Homo sapiens; identical to SEQ ID NO: 535441
  misc_feature: HIJSMM301B5R72.26.60.F05.1.454.light.4.raw

SEQ ID NO: 543238 - DNA, 461 bp, Homo sapiens
  misc_feature: HIJSMM301ASU94.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctccggtcactctgttcccaccctcctcacgcgtatgt

SEQ ID NO: 543239 - DNA, 514 bp, Homo sapiens
  misc_feature: HIJSMM301DWXTS.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggagggaccaaactgaccgtcctaggtcagcccaaggctgccccctcggtcactctgttcccta

SEQ ID NO: 543240 - DNA, 506 bp, Homo sapiens
  misc_feature: HIJSMM301ETPNK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtcaaacgaaactgtggctgcaccatctgtcttcatcttccccg

SEQ ID NO: 543241 - DNA, 478 bp, Homo sapiens
  misc_feature: HIJSMM301ERS1T.52.19.B08.1.454.light.4.raw
cgcagtacgacacgaccggtgctcgatttagtgagtcagtaagggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcacttttcggcgggggaccgaaggtggagatcaagcgaactgtggctgcaccta

SEQ ID NO: 543242 - DNA, 494 bp, Homo sapiens
  misc_feature: HIJSMM301B1J66.27.78.H01.1.454.light.4.raw
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtggctgcaccatctgtctt

SEQ ID NO: 543243 - DNA, 502 bp, Homo sapiens
  misc_feature: HIJSMM301EFPT8.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatggctatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtca

SEQ ID NO: 543244 - DNA, 496 bp, Homo sapiens
  misc_feature: HIJSMM301CLHPV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtcctaggtcagcccaagg

SEQ ID NO: 543245 - DNA, 498 bp, Homo sapiens
  misc_feature: HIJSMM301DO5EG.3.71.G05.1.454.light.4.raw
agacgcactccacgaccggtgctcgatttagtgtcgtcgcaagagagagggggcgagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctcg

SEQ ID NO: 543246 - DNA, 506 bp, Homo sapiens
  misc_feature: HIJSMM301CZXST.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtccaccgtcctaggtcagcccaaggccaaccc

SEQ ID NO: 543247 - DNA, 494 bp, Homo sapiens
  misc_feature: HIJSMM301AWBQ7.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 543248 - DNA, 489 bp, Homo sapiens
  misc_feature: HIJSMM301D2IYC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacagtacccccctcactttcggcggagggaccaaggcggagatcagacgaactgtggctgcaccatctgtcttca

SEQ ID NO: 543249 - DNA, 487 bp, Homo sapiens
  misc_feature: HIJSMM301AJ5N3.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgaaactgtggctgcaccatct

SEQ ID NO: 543250 - DNA, 487 bp, Homo sapiens
  misc_feature: HIJSMM301CH6G6.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagatttgccaattattatgcaacagcttaatagttacccgctcagtttcggcggagggaccaaggtggagatcaaacgaaactgtggctgacaccatctgtt

SEQ ID NO: 543251 - DNA, 491 bp, Homo sapiens; identical to SEQ ID NO: 536549
  misc_feature: HIJSMM301AVEPD.47.55.E11.1.454.light.4.raw

SEQ ID NO: 543252 - DNA, 487 bp, Homo sapiens; identical to SEQ ID NO: 541444
  misc_feature: HIJSMM301D6JPO.19.71.G05.1.454.light.4.raw

SEQ ID NO: 543253 - DNA, 496 bp, Homo sapiens; identical to SEQ ID NO: 535109
  misc_feature: HIJSMM301COOP5.16.78.H01.1.454.light.4.raw

SEQ ID NO: 543254 - DNA, 494 bp, Homo sapiens; identical to SEQ ID NO: 534992
  misc_feature: HIJSMM301AK7QK.9.1.A01.1.454.light.4.raw

SEQ ID NO: 543255 - DNA, 512 bp, Homo sapiens; identical to SEQ ID NO: 537564
  misc_feature: HIJSMM301B20W5.17.33.C11.1.454.light.4.raw

SEQ ID NO: 543256 - DNA, 492 bp, Homo sapiens; identical to SEQ ID NO: 534967
  misc_feature: HIJSMM301AR8XG.47.64.F09.1.454.light.4.raw

SEQ ID NO: 543257 - DNA, 486 bp, Homo sapiens; identical to SEQ ID NO: 535043
  misc_feature: HIJSMM301BT9QX.46.35.D02.1.454.light.4.raw

SEQ ID NO: 543258 - DNA, 488 bp, Homo sapiens
  misc_feature: HIJSMM301AMFWI.41.53.E09.1.454.light.4.raw
  modified_base (470)..(470): a, c, t, g, unknown or other
tctatactatcacgaccggtgctcgatttagagagagtgtgttgggtttgggggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccnccctcctcatagtataga

SEQ ID NO: 543259 - DNA, 447 bp, Homo sapiens; identical to SEQ ID NO: 535201
  misc_feature: HIJSMM301EIBF8.18.9.A09.1.454.light.4.raw

SEQ ID NO: 543260 - DNA, 495 bp, Homo sapiens
  misc_feature: HIJSMM301B3EUJ.52.36.D03.1.454.light.4.raw
cgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggaggaccaagctgaccgtcctacgtcagcccaaggctgccccctcggtcact

SEQ ID NO: 543261 - DNA, 489 bp, Homo sapiens
  misc_feature: HIJSMM301C8SUA.16.68.G02.1.454.light.4.raw
tgtactactccacgaccggtgctcgatttagtcgatagtgaagggaaaggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaacgaactgtggctgcaccatctgtcttcatt

SEQ ID NO: 543262 - DNA, 502 bp, Homo sapiens
  misc_feature: HIJSMM301AEF7O.49.46.E02.1.454.light.4.raw
agtcgagagacacgaccggtgctcgatttagactcatctacagggaaaggggggagcctgagaacacgtagccttcatgagtgtccccacccatggcctggatgatgcttctcctcggactccttgcttatggatcaggtgtggaatctcagactgtggtgacccaggagccatcgttgtcagtgtccccgggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatcacgggggcccaggcagatgatgaatgtgattattactgtgtgctgtatctgggtggtggctttttcgttgtcggcggagggaccaagctgaccgtcctacgtcagcccaaggctgccccctc

SEQ ID NO: 543263 - DNA, 485 bp, Homo sapiens
  misc_feature: HIJSMM301CCALX.5.42.D09.1.454.light.4.raw
  modified_base (460)..(460): a, c, t, g, unknown or other
  modified_base (474)..(474): a, c, t, g, unknown or other
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacgatccgagacgtcgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttatactgccaacaatataatagttattgacgtcgcacgggaggaaggtggaaatagngacggaactgtggngtgcaccatct

SEQ ID NO: 543264 - DNA, 495 bp, Homo sapiens; identical to SEQ ID NO: 537302
  misc_feature: HIJSMM301DX7ZY.9.1.A01.1.454.light.4.raw

SEQ ID NO: 543265 - DNA, 502 bp, Homo sapiens
  misc_feature: HIJSMM301BHA40.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaacccactgtcactctgttcccgccctcctcta

SEQ ID NO: 543266 - DNA, 509 bp, Homo sapiens
  misc_feature: HIJSMM301A1SQR.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 543267 - DNA, 472 bp, Homo sapiens
  misc_feature: HIJSMM301B9K51.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacttcggccaagggaccaaggtggaaatcaaacgaaa

SEQ ID NO: 543268 - DNA, 498 bp, Homo sapiens
  misc_feature: HIJSMM301AEA1Z.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccgaggggaccgaagctggagatcaaacgaactagtggctgcaccatctgtctt

SEQ ID NO: 543269 - DNA, 493 bp, Homo sapiens; identical to SEQ ID NO: 540903
  misc_feature: HIJSMM301D2IEC.10.20.B09.1.454.light.4.raw

SEQ ID NO: 543270 - DNA, 463 bp, Homo sapiens
  misc_feature: HIJSMM301BFRCY.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcgcggaggaccaaggtggagatac

SEQ ID NO: 543271 - DNA, 389 bp, Homo sapiens; identical to SEQ ID NO: 540091
  misc_feature: HIJSMM301CF8M4.21.40.D07.1.454.light.4.raw

SEQ ID NO: 543272 - DNA, 517 bp, Homo sapiens; identical to SEQ ID NO: 536980
  misc_feature: HIJSMM301AWGU9.5.27.C05.1.454.light.4.raw

SEQ ID NO: 543273 - DNA, 466 bp, Homo sapiens
  misc_feature: HIJSMM301CLMVU.48.2.A02.1.454.light.4.raw
agtatacatacacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcacaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgctcggccaggggaccaaagtggatgtcaaccgaa

SEQ ID NO: 543274 - DNA, 518 bp, Homo sapiens
  misc_feature: HIJSMM301AIJO7.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgctctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgccctcctcacgcg

SEQ ID NO: 543275 - DNA, 492 bp, Homo sapiens; identical to SEQ ID NO: 536087
  misc_feature: HIJSMM301COE96.10.17.B06.1.454.light.4.raw

SEQ ID NO: 543276 - DNA, 520 bp, Homo sapiens; identical to SEQ ID NO: 537173
  misc_feature: HIJSMM301D676C.27.23.C01.1.454.light.4.raw

SEQ ID NO: 543277 - DNA, 443 bp, Homo sapiens
  misc_feature: HIJSMM301DT0BI.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccgccctcctccatactcgta

SEQ ID NO: 543278 - DNA, 518 bp, Homo sapiens
  misc_feature: HIJSMM301CDCJW.13.25.C03.1.454.light.4.raw
tcacgtactacacgaccggtgctcgatttagtagtgtagatttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatggcaggttcttcttgtggtcttcggtcgggagggtccgaaacgtagaccgtccctacggttcgagcccgaacggcgtcgccccctcccggtc

SEQ ID NO: 543279 - DNA, 452 bp, Homo sapiens
  misc_feature: HIJSMM301D7HR9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttccaccctcctccacgagagta

SEQ ID NO: 543280 - DNA, 486 bp, Homo sapiens; identical to SEQ ID NO: 535043
  misc_feature: HIJSMM301AE0NJ.46.35.D02.1.454.light.4.raw

SEQ ID NO: 543281 - DNA, 494 bp, Homo sapiens
  misc_feature: HIJSMM301AMMHP.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaacgaactagtggctgcaccatctgtcttcat

SEQ ID NO: 543282 - DNA, 498 bp, Homo sapiens; identical to SEQ ID NO: 535469
  misc_feature: HIJSMM301AV3WC.12.18.B07.1.454.light.4.raw

SEQ ID NO: 543283 - DNA, 415 bp, Homo sapiens
  misc_feature: HIJSMM301A2LRD.40.36.D03.1.454.light.4.raw
tctagcgactcacgaccggtgctcgatttagctgcgtcacgatctctcttgggagttacccgattggagggcgttatccaccatcaactgcaagtccagccagagtgtttttcacacctccatgaacaaggagtacttggcttggttccagcagaaaccagggcagccccctaagctgctcatttactcggcatccacccggaaatccggagttcctgaccgattccgtggcagcgggtctgggacagattttactctcaccatcagtagcctgcagactgaagatgtggcagtttattactgtcaacaatattttcatactccgccgacgttcggccgggggaccaacgtggaaatcaaacgaactgtggctgcaccatctgtcttcatcttcccgccatctgaagtcgctaga

SEQ ID NO: 543284 - DNA, 447 bp, Homo sapiens; identical to SEQ ID NO: 535201
  misc_feature: HIJSMM301DWNGL.18.9.A09.1.454.light.4.raw

SEQ ID NO: 543285 - DNA, 526 bp, Homo sapiens
  misc_feature: HIJSMM301B8IPL.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggtccggggacccggaaacgtaggaaagtacaaacgaaactagtggcgtgcaccaactctgtcttcctatcttcccgtcccact

SEQ ID NO: 543286 - DNA, 486 bp, Homo sapiens; identical to SEQ ID NO: 538568
  misc_feature: HIJSMM301C9LZO.47.38.D05.1.454.light.4.raw

SEQ ID NO: 543287 - DNA, 463 bp, Homo sapiens
  misc_feature: HIJSMM301CRPTO.11.73.G07.1.454.light.4.raw
cgagagataccacgaccggtgctcgatttagctctacgctcagggggcgaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggcctgggaccagagtggacatgaaacgaa

SEQ ID NO: 543288 - DNA, 471 bp, Homo sapiens
  misc_feature: HIJSMM301CXWOY.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaaggaccaaggtaggaaatcaaacgaactagt

SEQ ID NO: 543289 - DNA, 460 bp, Homo sapiens; identical to SEQ ID NO: 537107
  misc_feature: HIJSMM301D92NH.22.28.C06.1.454.light.4.raw

SEQ ID NO: 543290 - DNA, 510 bp, Homo sapiens
  misc_feature: HIJSMM301CWRZO.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 543291 - DNA, 504 bp, Homo sapiens
  misc_feature: HIJSMM301DNSJZ.10.27.C05.1.454.light.4.raw
catagtagtgcacgaccggtgctcgatttagacgcgatcgaagggtttgggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctcctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 543292 - DNA, 479 bp, Homo sapiens; identical to SEQ ID NO: 537141
  misc_feature: HIJSMM301CMQY2.7.76.G10.1.454.light.4.raw

SEQ ID NO: 543293 - DNA, 510 bp, Homo sapiens
  misc_feature: HIJSMM301BDTEO.51.86.H09.1.454.light.4.raw
cgatcgtatacacgaccggtgctcgatttagtgctatagacttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtcttcta

SEQ ID NO: 543294 - DNA, 485 bp, Homo sapiens; identical to SEQ ID NO: 536695
  misc_feature: HIJSMM301DXTW5.10.1.A01.1.454.light.4.raw

SEQ ID NO: 543295 - DNA, 494 bp, Homo sapiens
  misc_feature: HIJSMM301AIUGF.22.65.F10.1.454.light.4.raw
acatacgcgtcacgaccggtgctcgatttagctacgctctaacggggacgtcagtctcagtcaggacacaggcagtggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcatt

SEQ ID NO: 543296 - DNA, 495 bp, Homo sapiens
  misc_feature: HIJSMM301EKTWL.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaaacgaactagtggctgcaccatctgtcttcatcttcccg

SEQ ID NO: 543297 - DNA, 489 bp, Homo sapiens
  misc_feature: HIJSMM301C0DXM.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacgatcaagcgaactgtggctgcaccatct

SEQ ID NO: 543298 - DNA, 502 bp, Homo sapiens; identical to SEQ ID NO: 536253
  misc_feature: HIJSMM301B6WWB.21.22.B11.1.454.light.4.raw

SEQ ID NO: 543299 - DNA, 503 bp, Homo sapiens
  misc_feature: HIJSMM301B97HT.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtcta

SEQ ID NO: 543300 - DNA, 512 bp, Homo sapiens
  misc_feature: HIJSMM301CNA58.8.23.C01.1.454.light.4.raw
  modified_base (503)..(503): a, c, t, g, unknown or other
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaacccactgtcactctgttcccncctcctcga

SEQ ID NO: 543301 - DNA, 513 bp, Homo sapiens
  misc_feature: HIJSMM301A61AA.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaagtacaaacgaaactacgtggcgtgcaccactctgtcttctatcttccccg

SEQ ID NO: 543302 - DNA, 510 bp, Homo sapiens
  misc_feature: HIJSMM301BPNDU.52.67.G01.1.454.light.4.raw
cgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactgtggctgcaccatctgtcttca

SEQ ID NO: 543303 - DNA, 502 bp, Homo sapiens
  misc_feature: HIJSMM301BTYP3.41.45.E01.1.454.light.4.raw
tctatactatcacgaccggtgctcgatttagtgagtcagtaagggaaaggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctcgccccctcggtcactctcg

SEQ ID NO: 543304 - DNA, 502 bp, Homo sapiens; identical to SEQ ID NO: 536253
  misc_feature: HIJSMM301D1BCS.21.22.B11.1.454.light.4.raw

SEQ ID NO: 543305 - DNA, 492 bp, Homo sapiens; identical to SEQ ID NO: 536733
  misc_feature: HIJSMM301DB2KS.40.11.A11.1.454.light.4.raw

SEQ ID NO: 543306 - DNA, 484 bp, Homo sapiens
  misc_feature: HIJSMM301AZQ5K.46.26.C04.1.454.light.4.raw
  modified_base (445)..(445): a, c, t, g, unknown or other
actagcagtacacgaccggtgctcgatttagtctagcgactttgggtttggggtgatcgaggactcctcagttcaccttctcacaatgaggctccctgctcagctcctgggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntcactttcggcggagggaccaaggtggagatcaaacgaa

SEQ ID NO: 543307 - DNA, 522 bp, Homo sapiens
  misc_feature: HIJSMM301C9U5F.27.23.C01.1.454.light.4.raw
  modified_base (505)..(505): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggagggaccaggctgaccgtcctaggtcagcccaaggctgccccctcggtnactctcgttcccgccct

SEQ ID NO: 543308 - DNA, 514 bp, Homo sapiens
  misc_feature: HIJSMM301D9GKY.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggcccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctgttcccgccct

SEQ ID NO: 543309 - DNA, 439 bp, Homo sapiens
  misc_feature: HIJSMM301DL2I2.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctggtcactctgttcccacctcctcgtatctctcg

SEQ ID NO: 543310 - DNA, 485 bp, Homo sapiens
  misc_feature: HIJSMM301DUTBN.43.60.F05.1.454.light.4.raw
tgtgagtagtcacgaccggtgctcgatttagtacgtcatcagggaaagggggaggtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaactttattactgtctacaagattcttcttaccctcggacgtcgtccgacggaccggacggtcggtagtggtcgtaacgacggaacgtagt

SEQ ID NO: 543311 - DNA, 504 bp, Homo sapiens
  misc_feature: HIJSMM301DZAJV.19.78.H01.1.454.light.4.raw
tactctcgtgcacgaccggtgctcgatttagtgtgagtagtttgggtttggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatctatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 543312 - DNA, 499 bp, Homo sapiens; identical to SEQ ID NO: 537739
  misc_feature: HIJSMM301CNE9C.12.86.H09.1.454.light.4.raw

SEQ ID NO: 543313 - DNA, 513 bp, Homo sapiens
  misc_feature: HIJSMM301CDUBB.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 543314 - DNA, 488 bp, Homo sapiens
  misc_feature: HIJSMM301AZ5Q7.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcga

SEQ ID NO: 543315 - DNA, 478 bp, Homo sapiens
  misc_feature: HIJSMM301E0QAT.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 543316 - DNA, 487 bp, Homo sapiens
  misc_feature: HIJSMM301ES3PQ.52.3.A03.1.454.light.4.raw
cgcagtacgacacgaccggtgctcgatttagagagcgtcacaggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaagcccctaaactcctgatctctaaggcatctgatttacaaactggggtcccgtcaaggttcagcggcagtggatctgggacagacttcactctcaccatcagcagcctgcagcctgatgactttgcaagttattattgccaacagtataacagtttttcattcacttttggccctgggacgacagtggatatcaaacgaactgtggctgcaccatctgtcttca

SEQ ID NO: 543317 - DNA, 481 bp, Homo sapiens; identical to SEQ ID NO: 535993
  misc_feature: HIJSMM301D02WC.21.25.C03.1.454.light.4.raw

SEQ ID NO: 543318 - DNA, 490 bp, Homo sapiens; identical to SEQ ID NO: 538273
  misc_feature: HIJSMM301D9K3L.16.73.G07.1.454.light.4.raw

SEQ ID NO: 543319 - DNA, 483 bp, Homo sapiens; identical to SEQ ID NO: 535413
  misc_feature: HIJSMM301CN92A.26.78.H01.1.454.light.4.raw

SEQ ID NO: 543320 - DNA, 486 bp, Homo sapiens; identical to SEQ ID NO: 535043
  misc_feature: HIJSMM301DP6E1.46.35.D02.1.454.light.4.raw

SEQ ID NO: 543321 - DNA, 484 bp, Homo sapiens
  misc_feature: HIJSMM301D4U0M.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaagtcaaacgaactagtggctgcaccatctgtcttcta

SEQ ID NO: 543322 - DNA, 500 bp, Homo sapiens
  misc_feature: HIJSMM301EBRG8.40.53.E09.1.454.light.4.raw
tctagcgactcacgaccggtgctcgatttagagagagtgtgttgggtttggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccaagctgaccgtcctaagtcagccaac

SEQ ID NO: 543323 - DNA, 494 bp, Homo sapiens; identical to SEQ ID NO: 534992
  misc_feature: HIJSMM301BSZ04.9.1.A01.1.454.light.4.raw

SEQ ID NO: 543324 - DNA, 418 bp, Homo sapiens; identical to SEQ ID NO: 536277
  misc_feature: HIJSMM301B9994.19.86.H09.1.454.light.4.raw

SEQ ID NO: 543325 - DNA, 460 bp, Homo sapiens; identical to SEQ ID NO: 536053
  misc_feature: HIJSMM301C3BG2.22.28.C06.1.454.light.4.raw

SEQ ID NO: 543326 - DNA, 502 bp, Homo sapiens
  misc_feature: HIJSMM301DESD7.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataattctgggtgttcggcggagggaccaaactgaccgtcctaggtcagcccaaggctgccccctcggtccactctgtt

SEQ ID NO: 543327 - DNA, 508 bp, Homo sapiens
  misc_feature: HIJSMM301AO0HZ.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtttgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcaggtctgaagattttgcagtttattattgtcagcagtataataactggcctccgtggacgttcggccgaacgggaccgaaggtaggaaagtcaaacgaacctagtggctgcaccatcctgtcttcat

SEQ ID NO: 543328 - DNA, 488 bp, Homo sapiens
  misc_feature: HIJSMM301CLQO6.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacgagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggccccgcgacgttcggccaagggaccgaggtggaattcaaacgaactgtggctgcaccatctgtctt

SEQ ID NO: 543329 - DNA, 494 bp, Homo sapiens
  misc_feature: HIJSMM301EIBPV.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagaattaaacgaactgtggctgcaccatctgtctt

SEQ ID NO: 543330 - DNA, 497 bp, Homo sapiens
  misc_feature: HIJSMM301CIC5V.9.39.D06.1.454.light.4.raw
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaagagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttcta

SEQ ID NO: 543331 - DNA, 502 bp, Homo sapiens; identical to SEQ ID NO: 537363
  misc_feature: HIJSMM301C1PUG.18.23.C01.1.454.light.4.raw

SEQ ID NO: 543332 - DNA, 489 bp, Homo sapiens; identical to SEQ ID NO: 535139
  misc_feature: HIJSMM301AMQ6V.14.55.E11.1.454.light.4.raw

SEQ ID NO: 543333 - DNA, 485 bp, Homo sapiens; identical to SEQ ID NO: 535880
  misc_feature: HIJSMM301DUTPT.7.75.G09.1.454.light.4.raw

SEQ ID NO: 543334 - DNA, 507 bp, Homo sapiens
  misc_feature: HIJSMM301BI3WM.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgagttccggggcagcgggtctgggacagatttcactctcaccatcagcagcctgcaggctgaagatggtggcagtttatactgtcagcaattatttttcttatcctccgtggacgttcggccaagggaccaggggtgaaatcagacgaactgtggctgcaccatctgtctt

SEQ ID NO: 543335 - DNA, 501 bp, Homo sapiens
  misc_feature: HIJSMM301C6XP0.9.71.G05.1.454.light.4.raw
tgatacgtctcacgaccggtgctcgatttagtgtcgtcgcaagagagaggggctttgcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttctaagatattcggcggagggaccaggctgaccgtcctgagtcagcccaaggctgccccctcggtcactctgttcccaccctcctcagacgtatca

SEQ ID NO: 543336 - DNA, 507 bp, Homo sapiens; identical to SEQ ID NO: 538313
  misc_feature: HIJSMM301D21DC.7.71.G05.1.454.light.4.raw

SEQ ID NO: 543337 - DNA, 488 bp, Homo sapiens; identical to SEQ ID NO: 537260
  misc_feature: HIJSMM301BZ31X.47.70.G04.1.454.light.4.raw

SEQ ID NO: 543338 - DNA, 477 bp, Homo sapiens
  misc_feature: HIJSMM301BN0E1.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctgatatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtgg

SEQ ID NO: 543339 - DNA, 483 bp, Homo sapiens; identical to SEQ ID NO: 535413
  misc_feature: HIJSMM301CJZPF.26.78.H01.1.454.light.4.raw

SEQ ID NO: 543340 - DNA, 498 bp, Homo sapiens
  misc_feature: HIJSMM301C6I32.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaaggctggagatcaaacgaactgtggctgcaccatctgtt

SEQ ID NO: 543341 - DNA, 471 bp, Homo sapiens; identical to SEQ ID NO: 537461
  misc_feature: HIJSMM301E0KP5.7.81.H04.1.454.light.4.raw

SEQ ID NO: 543342 - DNA, 491 bp, Homo sapiens
  misc_feature: HIJSMM301CV5UO.3.10.A10.1.454.light.4.raw
  modified_base (433)..(433): a, c, t, g, unknown or other
  modified_base (451)..(451): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatntcttcggatctgggaccngggtcaccgtcctaggtcagcccaaggccaacccacttcg

SEQ ID NO: 543343 - DNA, 485 bp, Homo sapiens
  misc_feature: HIJSMM301EAZJO.17.25.C03.1.454.light.4.raw
cgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaaagttgagatcaaacgaactgtggctgcaccatctgt

SEQ ID NO: 543344 - DNA, 478 bp, Homo sapiens
  misc_feature: HIJSMM301D7P16.48.70.G04.1.454.light.4.raw
agtatacatacacgaccggtgctcgatttagtgtagtgtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcc

SEQ ID NO: 543345 - DNA, 488 bp, Homo sapiens; identical to SEQ ID NO: 538858
  misc_feature: HIJSMM301A00YP.9.19.B08.1.454.light.4.raw

SEQ ID NO: 543346 - DNA, 463 bp, Homo sapiens; identical to SEQ ID NO: 535062
  misc_feature: HIJSMM301CLMFF.11.73.G07.1.454.light.4.raw

SEQ ID NO: 543347 - DNA, 500 bp, Homo sapiens
  misc_feature: HIJSMM301AT4S4.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcggtgttcggcgggggaccaagctgaccgtcctaggtcagcccaaggctgccccctcggtcactctgttccccg

SEQ ID NO: 543348 - DNA, 492 bp, Homo sapiens; identical to SEQ ID NO: 534967
  misc_feature: HIJSMM301EIJ0Y.47.64.F09.1.454.light.4.raw

SEQ ID NO: 543349 - DNA, 501 bp, Homo sapiens
  misc_feature: HIJSMM301CRNVP.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtattggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctccggtcactctgttcccta

SEQ ID NO: 543350 - DNA, 487 bp, Homo sapiens
  misc_feature: HIJSMM301CQ6N5.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatactttcgtggacgttcggccaagggaccaaggtggatatcagacgaa

SEQ ID NO: 543351 - DNA, 505 bp, Homo sapiens; identical to SEQ ID NO: 535987
  misc_feature: HIJSMM301EEE3X.18.37.D04.1.454.light.4.raw

SEQ ID NO: 543352 - DNA, 522 bp, Homo sapiens
  misc_feature: HIJSMM301ATHEO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccaccct

SEQ ID NO: 543353 - DNA, 473 bp, Homo sapiens; identical to SEQ ID NO: 538875
  misc_feature: HIJSMM301AWP94.4.75.G09.1.454.light.4.raw

SEQ ID NO: 543354 - DNA, 487 bp, Homo sapiens; identical to SEQ ID NO: 537079
  misc_feature: HIJSMM301D5JBS.14.55.E11.1.454.light.4.raw

SEQ ID NO: 543355 - DNA, 485 bp, Homo sapiens; identical to SEQ ID NO: 535985
  misc_feature: HIJSMM301AFUYQ.15.1.A01.1.454.light.4.raw

SEQ ID NO: 543356 - DNA, 509 bp, Homo sapiens
  misc_feature: HIJSMM301ETMNF.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaacgtaggatatcaaacgaactagtggctgcaccatctgtt

SEQ ID NO: 543357 - DNA, 492 bp, Homo sapiens; identical to SEQ ID NO: 537666
  misc_feature: HIJSMM301AU7LA.43.33.C11.1.454.light.4.raw

SEQ ID NO: 543358 - DNA, 441 bp, Homo sapiens; identical to SEQ ID NO: 535074
  misc_feature: HIJSMM301CMVL5.11.3.A03.1.454.light.4.raw

SEQ ID NO: 543359 - DNA, 487 bp, Homo sapiens; identical to SEQ ID NO: 538190
  misc_feature: HIJSMM301BY990.47.70.G04.1.454.light.4.raw

SEQ ID NO: 543360 - DNA, 499 bp, Homo sapiens
  misc_feature: HIJSMM301C1ZCX.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgccctcctccacgagagta

SEQ ID NO: 543361 - DNA, 501 bp, Homo sapiens; identical to SEQ ID NO: 536818
  misc_feature: HIJSMM301BBEJ6.12.82.H05.1.454.light.4.raw

SEQ ID NO: 543362 - DNA, 494 bp, Homo sapiens
  misc_feature: HIJSMM301CGH7Q.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcgccagaggccaggcccatctccaaggcgcctaatttataagctttctaaccgggactctggggtcccagacagattcagcggcagtggcactgatgtcacactgacaatcagcagggtggaggctgaggatgttggggtttggttcctccatgcaaggtacacactggccttttggccagggggccaacctggagatcaaatgaactgtggctgcaccatctgtctt

SEQ ID NO: 543363 - DNA, 503 bp, Homo sapiens
  misc_feature: HIJSMM301DRFZT.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 543364 - DNA, 485 bp, Homo sapiens; identical to SEQ ID NO: 535501
  misc_feature: HIJSMM301AOORO.3.10.A10.1.454.light.4.raw

SEQ ID NO: 543365 - DNA, 507 bp, Homo sapiens
  misc_feature: HIJSMM301BWKDJ.43.48.E04.1.454.light.4.raw
tgtgagtagtcacgaccggtgctcgatttagagagcgtcacagagagaaggggctgggcctcaggaagcagcatcgggggtgccgcagccatggcctggaccgctctccttctgagcctccttgctcactttacagagtctgtggcctcctacgagctgactcagccaccctcagtgtcagtggccctgggacaggcggccaggataacctgtgggggacacaatattgcagataagagtgtccactggtatcaccagaagcccggccaggcccctgtattggtcatctacagagacaccagccggcccgctgggatccctgagcgattctctgcctccaactcggggaacacggccaccctgaccatcagcagagcccaagtcggggatgagggtgactattactgtcaagtgtgggacaagagcactgtgattttcggcggaggggccaagttgaccgtttaggtcagcccaaggctgccccctcggtcactctgttcccgccct

SEQ ID NO: 543366 - DNA, 474 bp, Homo sapiens
  misc_feature: HIJSMM301AHJC3.9.76.G10.1.454.light.4.raw
tgatacgtctcacgaccggtgctcgatttagtcactcatacaggggagctgcgggtagagaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaaggctcccaaactcctcatctattatgatgatctgctgccctcaggggtctctgaccgattctctggctccaagtctggcacctcagcctccctggccatcagtgggctccagtctgaggatgaggctgattattactgtggagcatgggatgacagcctgaatgcttggatgttcggcggagggaccaagctgaccgtccta

SEQ ID NO: 543367 - DNA, 479 bp, Homo sapiens; identical to SEQ ID NO: 538734
  misc_feature: HIJSMM301DBUZM.8.53.E09.1.454.light.4.raw

SEQ ID NO: 543368 - DNA, 505 bp, Homo sapiens
  misc_feature: HIJSMM301AFB45.7.71.G05.1.454.light.4.raw
cgtgtctctacacgaccggtgctcgatttagtgtcgtcgcaagagagagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaaacgaactgtggctgcaccatctgtctt

SEQ ID NO: 543369 - DNA, 496 bp, Homo sapiens; identical to SEQ ID NO: 535109
  misc_feature: HIJSMM301ATZD8.16.78.H01.1.454.light.4.raw

SEQ ID NO: 543370 - DNA, 485 bp, Homo sapiens
  misc_feature: HIJSMM301CGZDQ.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcacgtcctaggtcagcccaaggccaaccca

SEQ ID NO: 543371 - DNA, 497 bp, Homo sapiens
  misc_feature: HIJSMM301EEMI4.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaactagtggctgcaccatctgtcttcatt

SEQ ID NO: 543372 - DNA, 491 bp, Homo sapiens
  misc_feature: HIJSMM301CXPF9.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgccctcctctacgtgagct

SEQ ID NO: 543373 - DNA, 489 bp, Homo sapiens; identical to SEQ ID NO: 535139
  misc_feature: HIJSMM301DAJ6L.14.55.E11.1.454.light.4.raw

SEQ ID NO: 543374 - DNA, 463 bp, Homo sapiens; identical to SEQ ID NO: 536878
  misc_feature: HIJSMM301BERDP.26.78.H01.1.454.light.4.raw

SEQ ID NO: 543375 - DNA, 485 bp, Homo sapiens
  misc_feature: HIJSMM301BL5RF.3.10.A10.1.454.light.4.raw
  modified_base (447)..(447): a, c, t, g, unknown or other
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatcngggaccagggtcaccgtcctaggtcagcccaaggccaa

SEQ ID NO: 543376 - DNA, 520 bp, Homo sapiens
  misc_feature: HIJSMM301EYDTA.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtca

SEQ ID NO: 543377 - DNA, 349 bp, Homo sapiens
  misc_feature: HIJSMM301AKN7O.12.53.E09.1.454.light.4.raw
atacgacgtacacgaccggtgctcgatttagagagagtgtgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccaccctcctctacgtcgtat

SEQ ID NO: 543378 - DNA, 487 bp, Homo sapiens; identical to SEQ ID NO: 536536
  misc_feature: HIJSMM301AK8CN.26.45.E01.1.454.light.4.raw

SEQ ID NO: 543379 - DNA, 447 bp, Homo sapiens; identical to SEQ ID NO: 535201
  misc_feature: HIJSMM301CP56N.18.9.A09.1.454.light.4.raw

SEQ ID NO: 543380 - DNA, 516 bp, Homo sapiens
  misc_feature: HIJSMM301BIWYA.52.67.G01.1.454.light.4.raw
cgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttattactgcatgcaaggtacacactggcctccgacgttcggccaagggaccaaggtggaaatcaaacgaactgtggctgcaccatctgtcttcatcttccccg

SEQ ID NO: 543381 - DNA, 494 bp, Homo sapiens
  misc_feature: HIJSMM301BWSIA.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaa

SEQ ID NO: 543382 - DNA, 501 bp, Homo sapiens
  misc_feature: HIJSMM301AFST7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctctacgttcggcggacggaacgaggcggagatacagaacgtaacgtggtcggctcgccacctatctcgttctta

SEQ ID NO: 543383 - DNA, 512 bp, Homo sapiens
  misc_feature: HIJSMM301E2HGI.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaacgtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtccgtgggtcagccccaaggctcgccccctcggtcactctgttccccg

SEQ ID NO: 543384 - DNA, 482 bp, Homo sapiens; identical to SEQ ID NO: 535920
  misc_feature: HIJSMM301DC6EJ.19.71.G05.1.454.light.4.raw

SEQ ID NO: 543385 - DNA, 497 bp, Homo sapiens; identical to SEQ ID NO: 536371
  misc_feature: HIJSMM301A91JU.16.78.H01.1.454.light.4.raw

SEQ ID NO: 543386 - DNA, 487 bp, Homo sapiens; identical to SEQ ID NO: 536196
  misc_feature: HIJSMM301BJ0F2.11.28.C06.1.454.light.4.raw

SEQ ID NO: 543387 - DNA, 502 bp, Homo sapiens
  misc_feature: HIJSMM301AOA7W.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccgaaacgtggatatcaacgaactagtggctgcaccatctgtcttcat

SEQ ID NO: 543388 - DNA, 484 bp, Homo sapiens; identical to SEQ ID NO: 535240
  misc_feature: HIJSMM301AILAQ.47.60.F05.1.454.light.4.raw

SEQ ID NO: 543389 - DNA, 505 bp, Homo sapiens; identical to SEQ ID NO: 539204
  misc_feature: HIJSMM301EUCOY.17.41.D08.1.454.light.4.raw

SEQ ID NO: 543390 - DNA, 494 bp, Homo sapiens
  misc_feature: HIJSMM301BCMJX.16.6.A06.1.454.light.4.raw
  modified_base (416)..(416): a, c, t, g, unknown or other
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattacngtcagcagtattatactactcctctgacgttcggccaagggaccaaggtggagatcaaacgaactgtggctgcaccat

SEQ ID NO: 543391 - DNA, 501 bp, Homo sapiens; identical to SEQ ID NO: 535746
  misc_feature: HIJSMM301DKHKH.18.11.A11.1.454.light.4.raw

SEQ ID NO: 543392 - DNA, 504 bp, Homo sapiens; identical to SEQ ID NO: 534983
  misc_feature: HIJSMM301B7OX7.9.12.B01.1.454.light.4.raw

SEQ ID NO: 543393 - DNA, 497 bp, Homo sapiens
  misc_feature: HIJSMM301DGI1M.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccaagggaccaaggtaggaaatcaaacgaactgtggctgcacca

SEQ ID NO: 543394 - DNA, 503 bp, Homo sapiens; identical to SEQ ID NO: 538884
  misc_feature: HIJSMM301CW4EK.27.78.H01.1.454.light.4.raw

SEQ ID NO: 543395 - DNA, 489 bp, Homo sapiens
  misc_feature: HIJSMM301AEGXY.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctcgggacgtaaggtggaggatcagacgaactgtggctgcaccactctgtcttcta

SEQ ID NO: 543396 - DNA, 487 bp, Homo sapiens
  misc_feature: HIJSMM301BZOJH.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggagatcaaacgtaacg

SEQ ID NO: 543397 - DNA, 457 bp, Homo sapiens; identical to SEQ ID NO: 536586
  misc_feature: HIJSMM301AIUZY.49.85.H08.1.454.light.4.raw

SEQ ID NO: 543398 - DNA, 494 bp, Homo sapiens
  misc_feature: HIJSMM301AL04W.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaacggtggaggatcaagcgaactgtggctgcaccatctgtcttcatcttcccg

SEQ ID NO: 543399 - DNA, 516 bp, Homo sapiens
  misc_feature: HIJSMM301A084B.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctccc

SEQ ID NO: 543400 - DNA, 492 bp, Homo sapiens; identical to SEQ ID NO: 536087
  misc_feature: HIJSMM301BEJVR.10.17.B06.1.454.light.4.raw

SEQ ID NO: 543401 - DNA, 494 bp, Homo sapiens; identical to SEQ ID NO: 534992
  misc_feature: HIJSMM301B1UL7.9.1.A01.1.454.light.4.raw

SEQ ID NO: 543402 - DNA, 508 bp, Homo sapiens
  misc_feature: HIJSMM301AKEC5.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcgaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 543403 - DNA, 444 bp, Homo sapiens; identical to SEQ ID NO: 535192
  misc_feature: HIJSMM301B0DN2.5.9.A09.1.454.light.4.raw

SEQ ID NO: 543404 - DNA, 488 bp, Homo sapiens
  misc_feature: HIJSMM301ASV1I.15.67.G01.1.454.light.4.raw
  modified_base (447)..(447): a, c, t, g, unknown or other
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgtcggtccncgggacgaacggtaggaagtacaaacgaactagtggcgtgc

SEQ ID NO: 543405 - DNA, 505 bp, Homo sapiens
  misc_feature: HIJSMM301DGMMK.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtgaccgtcctaggtcagcccaaggctgccccccg

SEQ ID NO: 543406 - DNA, 489 bp, Homo sapiens; identical to SEQ ID NO: 535139
  misc_feature: HIJSMM301DNRQF.14.55.E11.1.454.light.4.raw

SEQ ID NO: 543407 - DNA, 505 bp, Homo sapiens
  misc_feature: HIJSMM301CH0QV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaaggaccgaacggtggaaatacaaacgaactagtggctgcaccatctgtcttcatcttccccg

SEQ ID NO: 543408 - DNA, 454 bp, Homo sapiens; identical to SEQ ID NO: 535005
  misc_feature: HIJSMM301DEJJM.19.86.H09.1.454.light.4.raw

SEQ ID NO: 543409 - DNA, 446 bp, Homo sapiens
  misc_feature: HIJSMM301A8BSH.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctccggtcactctgttcccaccctcctccgacacgcgag

SEQ ID NO: 543410 - DNA, 500 bp, Homo sapiens
  misc_feature: HIJSMM301CF9II.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatatgcttattggtaccaacagaagtcaggccaggcccctgtgctggtcatctatgaggacaacaaacgaccctccgagtatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcta

SEQ ID NO: 543411 - DNA, 486 bp, Homo sapiens
  misc_feature: HIJSMM301DH888.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaagtgggatatcagacgaa

SEQ ID NO: 543412 - DNA, 507 bp, Homo sapiens
  misc_feature: HIJSMM301ETFUF.43.38.D05.1.454.light.4.raw
tgtgagtagtcacgaccggtgctcgatttagtatctgatagttgggtttggggtctgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaagtcaaacgaactagt

SEQ ID NO: 543413 - DNA, 489 bp, Homo sapiens
  misc_feature: HIJSMM301DAB76.51.83.H06.1.454.light.4.raw
cgatcgtatacacgaccggtgctcgatttagatcacgtgcgtcgcggggagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatcttcccgccatctgatcgt

SEQ ID NO: 543414 - DNA, 499 bp, Homo sapiens
  misc_feature: HIJSMM301DEACB.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaaggtggaaatcaaacgaactgtggctgcacc

SEQ ID NO: 543415 - DNA, 501 bp, Homo sapiens; identical to SEQ ID NO: 535746
  misc_feature: HIJSMM301CPITE.18.11.A11.1.454.light.4.raw

SEQ ID NO: 543416 - DNA, 444 bp, Homo sapiens; identical to SEQ ID NO: 536484
  misc_feature: HIJSMM301BAKSM.8.11.A11.1.454.light.4.raw

SEQ ID NO: 543417 - DNA, 475 bp, Homo sapiens
  misc_feature: HIJSMM301CWEZ4.4.63.F08.1.454.light.4.raw
agcactgtagcacgaccggtgctcgatttagcgatcgtataagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgtacaagtcagagcattaacatctatttaaattggtatcagcagcaatcagggaaagcccctaaactcctgatctatgatggatccactttggaacatggggtcccttcaaggttcagtggcagtggatctgggacagagttcactctcaccatcagccgtctgcaacctgaagattttgcaacttactactgtcaacagagttacaatctcccgctcactttcggcggagggacgaaggtggagatcaaacgaactgtggctgcacc

SEQ ID NO: 543418 - DNA, 487 bp, Homo sapiens
  misc_feature: HIJSMM301AX988.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgctgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccaaggtgaggtcaaacgaactgtggctgcaccatctgtcttca

SEQ ID NO: 543419 - DNA, 508 bp, Homo sapiens
  misc_feature: HIJSMM301BQTHB.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgccccctcggtcactctgttcccta

SEQ ID NO: 543420 - DNA, 485 bp, Homo sapiens
  misc_feature: HIJSMM301EEOFB.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggaggaccaaggtggagatcaaacgaactgtggctgcacca

SEQ ID NO: 543421 - DNA, 372 bp, Homo sapiens
  misc_feature: HIJSMM301BP3UT.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcccccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgcccctcggtcactctgttcccaccctcctccgagcgacga

SEQ ID NO: 543422 - DNA, 403 bp, Homo sapiens
  misc_feature: HIJSMM301AGSA5.4.35.D02.1.454.light.4.raw
agcactgtagcacgaccggtgctcgatttagcacacgatagttgggtttggggtttcatgagtgcagggagacggccaggattacttgtgggggagacaacattggagataaaagtgtgcactggtaccagcagaagccaggccaggcccctctgatggtcatctatttcgatagcgaccggccctcaggaatccctgcgcgattctcggggtccaactctgggagcacggccaccctgaccatcagtagtgtcgaagccggtgatgaggccgactatttctgtcaggtgtgggctactcgcagtgacctctgcgtcttcggaagtgggaccaaggtcaccgtcttaggtcagcccaaggccaaccccactgtcactctgttcccaccctcctctacagtgct

SEQ ID NO: 543423 - DNA, 495 bp, Homo sapiens; identical to SEQ ID NO: 537273
  misc_feature: HIJSMM301BFXT1.15.26.C04.1.454.light.4.raw

SEQ ID NO: 543424 - DNA, 467 bp, Homo sapiens
  misc_feature: HIJSMM301C1XN7.52.9.A09.1.454.light.4.raw
cgcagtacgacacgaccggtgctcgatttagcgagacgcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcggagggaccaaaggtggagatcaaacgaa

SEQ ID NO: 543425 - DNA, 490 bp, Homo sapiens
  misc_feature: HIJSMM301BZHMH.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaatacaaacgaactagtggctgcaccatctgtcttcta

SEQ ID NO: 543426 - DNA, 494 bp, Homo sapiens; identical to SEQ ID NO: 537003
  misc_feature: HIJSMM301EDJ4I.10.79.H02.1.454.light.4.raw

SEQ ID NO: 543427 - DNA, 484 bp, Homo sapiens
  misc_feature: HIJSMM301BPBHH.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccat

SEQ ID NO: 543428 - DNA, 483 bp, Homo sapiens
  misc_feature: HIJSMM301CF0EU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggtctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 543429 - DNA, 472 bp, Homo sapiens; identical to SEQ ID NO: 535898
  misc_feature: HIJSMM301EFTJE.15.8.A08.1.454.light.4.raw

SEQ ID NO: 543430 - DNA, 445 bp, Homo sapiens
  misc_feature: HIJSMM301BXWOF.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcgggcggagggaccaagctgaccgtcctaagtcagcccaaggctgccccctcggtcactctgttcccgccctcctccgtgtctgat

SEQ ID NO: 543431 - DNA, 504 bp, Homo sapiens
  misc_feature: HIJSMM301DNKHV.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctgggtcaggcccaaggctgccccccg

SEQ ID NO: 543432 - DNA, 482 bp, Homo sapiens; identical to SEQ ID NO: 535216
  misc_feature: HIJSMM301BIKQL.17.26.C04.1.454.light.4.raw

SEQ ID NO: 543433 - DNA, 519 bp, Homo sapiens
  misc_feature: HIJSMM301BL9UG.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactact

SEQ ID NO: 543434 - DNA, 486 bp, Homo sapiens; identical to SEQ ID NO: 535043
  misc_feature: HIJSMM301DDZHR.46.35.D02.1.454.light.4.raw

SEQ ID NO: 543435 - DNA, 383 bp, Homo sapiens; identical to SEQ ID NO: 447524
  misc_feature: HIJSMM301E1CQ3.41.26.C04.1.454.light.4.raw

SEQ ID NO: 543436 - DNA, 507 bp, Homo sapiens
  misc_feature: HIJSMM301AI75P.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatctttccgccat

SEQ ID NO: 543437 - DNA, 422 bp, Homo sapiens
  misc_feature: HIJSMM301AJ41T.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgcccctcggtcactctgttcccaccctcctcagacgtatca

SEQ ID NO: 543438 - DNA, 434 bp, Homo sapiens; identical to SEQ ID NO: 536762
  misc_feature: HIJSMM301AOAXA.48.1.A01.1.454.light.4.raw

SEQ ID NO: 543439 - DNA, 444 bp, Homo sapiens; identical to SEQ ID NO: 534993
  misc_feature: HIJSMM301DKRSG.5.9.A09.1.454.light.4.raw

SEQ ID NO: 543440 - DNA, 496 bp, Homo sapiens; identical to SEQ ID NO: 535109
  misc_feature: HIJSMM301AXSEX.16.78.H01.1.454.light.4.raw

SEQ ID NO: 543441 - DNA, 485 bp, Homo sapiens
  misc_feature: HIJSMM301C8D0W.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccaagctggagatcacaggaactgtggctgcacc

SEQ ID NO: 543442 - DNA, 502 bp, Homo sapiens
  misc_feature: HIJSMM301EEW35.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgtt

SEQ ID NO: 543443 - DNA, 500 bp, Homo sapiens
  misc_feature: HIJSMM301C0MR0.48.78.H01.1.454.light.4.raw
agtatacatacacgaccggtgctcgatttagtgtgagtagtttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctc

SEQ ID NO: 543444 - DNA, 488 bp, Homo sapiens
  misc_feature: HIJSMM301AS92C.51.29.C07.1.454.light.4.raw
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataattcttggaggagatcacacgttggaactgtggctgcaccatctgtcttcatcttcccgccatctgatcgt

SEQ ID NO: 543445 - DNA, 474 bp, Homo sapiens; identical to SEQ ID NO: 536662
  misc_feature: HIJSMM301BUUL1.40.59.F04.1.454.light.4.raw

SEQ ID NO: 543446 - DNA, 485 bp, Homo sapiens; identical to SEQ ID NO: 536040
  misc_feature: HIJSMM301AVXN1.15.1.A01.1.454.light.4.raw

SEQ ID NO: 543447 - DNA, 482 bp, Homo sapiens
  misc_feature: HIJSMM301AMA4J.48.57.F02.1.454.light.4.raw
agtatacatacacgaccggtgctcgatttagctcgatatagttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctccaggtattcctgagcgattctctggctccagttctgggaacacagccactctgaccatcagcgggaccccgacggcgtatggatgaggctgactattactgtcaggcgtgggacatcagcagtgaggtgggttttcggtcggagggaccgaacgactgaccgtccctaacgt

SEQ ID NO: 543448 - DNA, 460 bp, Homo sapiens; identical to SEQ ID NO: 536053
  misc_feature: HIJSMM301C1PTX.22.28.C06.1.454.light.4.raw

SEQ ID NO: 543449 - DNA, 486 bp, Homo sapiens; identical to SEQ ID NO: 535290
  misc_feature: HIJSMM301A0K3Y.3.12.B01.1.454.light.4.raw

SEQ ID NO: 543450 - DNA, 486 bp, Homo sapiens; identical to SEQ ID NO: 541163
  misc_feature: HIJSMM301CAH23.19.57.F02.1.454.light.4.raw

SEQ ID NO: 543451 - DNA, 445 bp, Homo sapiens
  misc_feature: HIJSMM301DJPFX.9.71.G05.1.454.light.4.raw
tgatacgtctcacgaccggtgctcgatttagtgtcgtcgcaagagagagggggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctcagacgtatca

SEQ ID NO: 543452 - DNA, 492 bp, Homo sapiens
  misc_feature: HIJSMM301D1XKV.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgctagtttattactgtcagcagcgtagcaactggcctctcaccttcggcggagggaccaaggtggagatcaaacgaactgtggctgcaccatctgtt

SEQ ID NO: 543453 - DNA, 494 bp, Homo sapiens; identical to SEQ ID NO: 538639
  misc_feature: HIJSMM301B2DWR.43.55.E11.1.454.light.4.raw

SEQ ID NO: 543454 - DNA, 513 bp, Homo sapiens; identical to SEQ ID NO: 535244
  misc_feature: HIJSMM301B8C7D.17.33.C11.1.454.light.4.raw

SEQ ID NO: 543455 - DNA, 501 bp, Homo sapiens
  misc_feature: HIJSMM301EXDAA.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtgggaaagtcaaacgaactgtggctgcacc

SEQ ID NO: 543456 - DNA, 447 bp, Homo sapiens; identical to SEQ ID NO: 535020
  misc_feature: HIJSMM301DZBHQ.18.9.A09.1.454.light.4.raw

SEQ ID NO: 543457 - DNA, 512 bp, Homo sapiens; identical to SEQ ID NO: 541300
  misc_feature: HIJSMM301AYWI7.17.33.C11.1.454.light.4.raw

SEQ ID NO: 543458 - DNA, 444 bp, Homo sapiens; identical to SEQ ID NO: 535192
  misc_feature: HIJSMM301EN37D.5.9.A09.1.454.light.4.raw

SEQ ID NO: 543459 - DNA, 473 bp, Homo sapiens
  misc_feature: HIJSMM301AQX58.43.38.D05.1.454.light.4.raw
tgtgagtagtcacgaccggtgctcgatttagtatctgatagttgggtttgggggctttccctggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaagtcaaacgaactgtggctgcaccatctgtcttcatcttcccgccatctgaactactcaca

SEQ ID NO: 543460 - DNA, 440 bp, Homo sapiens
  misc_feature: HIJSMM301DV805.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctggtcactctgttcccaccctcctcgtatctctcg

SEQ ID NO: 543461 - DNA, 517 bp, Homo sapiens
  misc_feature: HIJSMM301AKUA5.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacgggaccgacacgtagaaatagagacgaaccgtagtggcgtgtcgaccactctcgtcttctactcttcccgtccc

SEQ ID NO: 543462 - DNA, 494 bp, Homo sapiens
  misc_feature: HIJSMM301C7X0G.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttcat

SEQ ID NO: 543463 - DNA, 493 bp, Homo sapiens
  misc_feature: HIJSMM301CDW2V.48.10.A10.1.454.light.4.raw
agtatacatacacgaccggtgctcgatttagcgtcgatctcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaacgggaccacgggtggaaagtacaaacgaaactagtggcgtgcaccactctgtcttctatt

SEQ ID NO: 543464 - DNA, 490 bp, Homo sapiens
  misc_feature: HIJSMM301BUQ7Z.22.86.H09.1.454.light.4.raw
acatacgcgtcacgaccggtgctcgatttagtgctatagacttgggtttggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaa

SEQ ID NO: 543465 - DNA, 509 bp, Homo sapiens; identical to SEQ ID NO: 535670
  misc_feature: HIJSMM301C9X1Y.47.23.C01.1.454.light.4.raw

SEQ ID NO: 543466 - DNA, 487 bp, Homo sapiens; identical to SEQ ID NO: 538190
  misc_feature: HIJSMM301DJCY9.47.70.G04.1.454.light.4.raw

SEQ ID NO: 543467 - DNA, 463 bp, Homo sapiens; identical to SEQ ID NO: 535062
  misc_feature: HIJSMM301E2GDN.11.73.G07.1.454.light.4.raw

SEQ ID NO: 543468 - DNA, 513 bp, Homo sapiens
  misc_feature: HIJSMM301A5172.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcggccaacgggaccgaaggtaggaaagtacaaacgaaactagtggcgtcgcaccaactctgtcttctatcttccccg

SEQ ID NO: 543469 - DNA, 484 bp, Homo sapiens; identical to SEQ ID NO: 535400
  misc_feature: HIJSMM301BJTYJ.46.26.C04.1.454.light.4.raw

SEQ ID NO: 543470 - DNA, 522 bp, Homo sapiens
  misc_feature: HIJSMM301CD5XN.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtcg

SEQ ID NO: 543471 - DNA, 455 bp, Homo sapiens
  misc_feature: HIJSMM301AF405.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttttcggcggagggaccaagctgaccgtccctaagtcagcccaaggctgccccctcggtcactctgttcccaccctcctccacgagagta

SEQ ID NO: 543472 - DNA, 494 bp, Homo sapiens; identical to SEQ ID NO: 534994
  misc_feature: HIJSMM301DNB7P.27.78.H01.1.454.light.4.raw

SEQ ID NO: 543473 - DNA, 510 bp, Homo sapiens; identical to SEQ ID NO: 535474
  misc_feature: HIJSMM301ADZ9G.17.33.C11.1.454.light.4.raw

SEQ ID NO: 543474 - DNA, 484 bp, Homo sapiens; identical to SEQ ID NO: 535400
  misc_feature: HIJSMM301C5KZK.46.26.C04.1.454.light.4.raw

SEQ ID NO: 543475 - DNA, 485 bp, Homo sapiens
  misc_feature: HIJSMM301B3SG1.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagattttcactctcaccatcaatcacctgcaggctgaggattttgcaacttactactgtcagcaggctaacaggctgcccccaaccttcggccagggacacgactgagattaaacgaactgtggctgcaccatctgtt

SEQ ID NO: 543476 - DNA, 492 bp, Homo sapiens
  misc_feature: HIJSMM301CFE5M.51.6.A06.1.454.light.4.raw
cgatcgtatacacgaccggtgctcgatttagatctactgacagggggctgtgggtccaggaggcagaactctgggtgtctcaccatggcctggacccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccagggtcaccgtcctaggtcagcccaaggccaaccccactgtcact

SEQ ID NO: 543477 - DNA, 454 bp, Homo sapiens; identical to SEQ ID NO: 535005
  misc_feature: HIJSMM301CLWAP.19.86.H09.1.454.light.4.raw

SEQ ID NO: 543478 - DNA, 491 bp, Homo sapiens
  misc_feature: HIJSMM301EJXAQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccgaaggcggagatcagacgaactgtggctgcaccatctgtcttcta

SEQ ID NO: 543479 - DNA, 509 bp, Homo sapiens; identical to SEQ ID NO: 543266
  misc_feature: HIJSMM301EDN5G.17.33.C11.1.454.light.4.raw

SEQ ID NO: 543480 - DNA, 502 bp, Homo sapiens; identical to SEQ ID NO: 537363
  misc_feature: HIJSMM301BS66N.18.23.C01.1.454.light.4.raw

SEQ ID NO: 543481 - DNA, 485 bp, Homo sapiens; identical to SEQ ID NO: 535688
  misc_feature: HIJSMM301BKG9Z.19.5.A05.1.454.light.4.raw

SEQ ID NO: 543482 - DNA, 518 bp, Homo sapiens
  misc_feature: HIJSMM301CC6YG.51.41.D08.1.454.light.4.raw
cgatcgtatacacgaccggtgctcgatttagtcacgcgagaaagggaaaggggggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtgggggatgagggtgattactactgttactcaacagacattactactactcatagggtgttcggcggagggaccaagctgaccgtcctaggtcagcccaaggctgccccctcggtcactctgttcccgccctcctctcgta

SEQ ID NO: 543483 - DNA, 496 bp, Homo sapiens; identical to SEQ ID NO: 542070
  misc_feature: HIJSMM301BC8XE.22.14.B03.1.454.light.4.raw

SEQ ID NO: 543484 - DNA, 515 bp, Homo sapiens
  misc_feature: HIJSMM301EVKYC.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctcaaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctcg

SEQ ID NO: 543485 - DNA, 487 bp, Homo sapiens; identical to SEQ ID NO: 539157
  misc_feature: HIJSMM301DN9MR.26.37.D04.1.454.light.4.raw

SEQ ID NO: 543486 - DNA, 414 bp, Homo sapiens; identical to SEQ ID NO: 536609
  misc_feature: HIJSMM301DMEDP.16.46.E02.1.454.light.4.raw

SEQ ID NO: 543487 - DNA, 500 bp, Homo sapiens
  misc_feature: HIJSMM301DVAT1.49.62.F07.1.454.light.4.raw
agtcgagagacacgaccggtgctcgatttagtagtcgcataaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcactctaatgactggcccctgtacacttttggcccggggaccgaaggtggagatcaaacgaactgtggctgcaccatctgtcttcta

SEQ ID NO: 543488 - DNA, 444 bp, Homo sapiens; identical to SEQ ID NO: 535192
  misc_feature: HIJSMM301DXZC9.5.9.A09.1.454.light.4.raw

SEQ ID NO: 543489 - DNA, 506 bp, Homo sapiens
  misc_feature: HIJSMM301BCR7P.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagttcgccccccgactcaccttccggtccgaacggacgacacgtggaggaattaaacgtaaactgtggcgtgcaccaactctcgtcttctact

SEQ ID NO: 543490 - DNA, 511 bp, Homo sapiens
  misc_feature: HIJSMM301DD8SM.48.13.B02.1.454.light.4.raw
  modified_base (507)..(507): a, c, t, g, unknown or other
agtatacatacacgaccggtgctcgatttagtctagcgacttccgcggggggcgtcagaagcagagttctggggtgtctccaccatggcctggacccctctctggctcactctcctcactctttgcataggctctgtggtttcttctgagctgactcaggaccctgctgtgtctgtggccttgggacagacggtcaggatcacatgccaaggagacagcctcagaaagttttctggaaactggtatcagcagaagccaggacaggcccctgttcttctcatctatggtgaaaatcaccggcccccagggatcccagaccgattctctggctctacctcaggagacacagcttccctgaccatcgctggggctcaggctgaagatgaggctgcctattattgtaactcccgggacagtagaggcgactatttcctaatattcggcggagggaccaagttgaccgtcctaggtcagcccaaggctgccccctcggtcactctgttcccnccct

SEQ ID NO: 543491 - DNA, 497 bp, Homo sapiens; identical to SEQ ID NO: 535764
  misc_feature: HIJSMM301CV2CS.22.20.B09.1.454.light.4.raw

SEQ ID NO: 543492 - DNA, 506 bp, Homo sapiens; identical to SEQ ID NO: 534969
  misc_feature: HIJSMM301BFHWJ.18.37.D04.1.454.light.4.raw

SEQ ID NO: 543493 - DNA, 448 bp, Homo sapiens
  misc_feature: HIJSMM301CY682.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctccaggggtcccgtgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctccggtcactctcgttcccgccctcctccgtgtctgat

SEQ ID NO: 543494 - DNA, 509 bp, Homo sapiens
  misc_feature: HIJSMM301CHBD7.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctggtcactctgttccca

SEQ ID NO: 543495 - DNA, 502 bp, Homo sapiens; identical to SEQ ID NO: 543172
  misc_feature: HIJSMM301B7ABN.18.59.F04.1.454.light.4.raw

SEQ ID NO: 543496 - DNA, 416 bp, Homo sapiens; identical to SEQ ID NO: 535308
  misc_feature: HIJSMM301CAVMF.16.46.E02.1.454.light.4.raw

SEQ ID NO: 543497 - DNA, 481 bp, Homo sapiens
  misc_feature: HIJSMM301BH9XE.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacagggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcacc

SEQ ID NO: 543498 - DNA, 506 bp, Homo sapiens
  misc_feature: HIJSMM301C7VHW.15.86.H09.1.454.light.4.raw
tctacgtagccacgaccggtgctcgatttagtgctatagacttgggtttggggggacttccctggtctccttctacctactgcccttcatttcttccacaggtctctgtgctctgcctgtgctgactcagcccccgtcctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcg

SEQ ID NO: 543499 - DNA, 496 bp, Homo sapiens; identical to SEQ ID NO: 537681
  misc_feature: HIJSMM301CU1VR.40.23.C01.1.454.light.4.raw

SEQ ID NO: 543500 - DNA, 479 bp, Homo sapiens; identical to SEQ ID NO: 535118
  misc_feature: HIJSMM301ALZUH.13.59.F04.1.454.light.4.raw

SEQ ID NO: 543501 - DNA, 517 bp, Homo sapiens
  misc_feature: HIJSMM301BOXYB.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccgccctcct

SEQ ID NO: 543502 - DNA, 454 bp, Homo sapiens; identical to SEQ ID NO: 536449
  misc_feature: HIJSMM301B36PH.18.78.H01.1.454.light.4.raw

SEQ ID NO: 543503 - DNA, 485 bp, Homo sapiens; identical to SEQ ID NO: 540285
  misc_feature: HIJSMM301CC54N.46.26.C04.1.454.light.4.raw

SEQ ID NO: 543504 - DNA, 495 bp, Homo sapiens
  misc_feature: HIJSMM301B2EFI.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaactgtggctgcaccatctgtcttcat

SEQ ID NO: 543505 - DNA, 493 bp, Homo sapiens
  misc_feature: HIJSMM301BWYMM.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacgatcaagcgaactgtggctgcaccatctgtt

SEQ ID NO: 543506 - DNA, 492 bp, Homo sapiens
  misc_feature: HIJSMM301C64SE.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcgtgggaccaagctgaccgtcctaggtcagcccaagg

SEQ ID NO: 543507 - DNA, 518 bp, Homo sapiens
  misc_feature: HIJSMM301EIREU.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctcgtcccaccctcctccacg

SEQ ID NO: 543508 - DNA, 496 bp, Homo sapiens
  misc_feature: HIJSMM301EKJP4.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcactcg

SEQ ID NO: 543509 - DNA, 441 bp, Homo sapiens; identical to SEQ ID NO: 535074
  misc_feature: HIJSMM301CUFHU.11.3.A03.1.454.light.4.raw

SEQ ID NO: 543510 - DNA, 500 bp, Homo sapiens
  misc_feature: HIJSMM301ANKNG.43.34.D01.1.454.light.4.raw
tgtgagtagtcacgaccggtgctcgatttagatcgtctgtggttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccc

SEQ ID NO: 543511 - DNA, 498 bp, Homo sapiens
  misc_feature: HIJSMM301DCUW6.51.46.E02.1.454.light.4.raw
cgatcgtatacacgaccggtgctcgattagactcatctacagggaaaggggctgatcaggactcctcagttcaccctctcacaatgaggctccctgctcagctcctggggctgctaatgctctgggtcccaggatgcagtggggctgttgtgatgactcagtctccactctccctgcccgtcacccttggacagccggcctccatctcctgcaggtctagtcaaggcctcgtttatagtgatggagacacctacttgagttggtttcaccagaggccaggccaatctccaaggcgcctaatttataaggtttctaaccgggactctggggtcccagacaaattcagcggcagtgggtcaggcactgatttcacactgaaaatcagcagggtggaggctgaggatgttgggatttactactgtatgcaaggtacacactggcctctcactttcggcggagggaccaaggtggagatgaaacgaactgtggctgcaccat

SEQ ID NO: 543512 - DNA, 485 bp, Homo sapiens; identical to SEQ ID NO: 536040
  misc_feature: HIJSMM301BIJN3.15.1.A01.1.454.light.4.raw

SEQ ID NO: 543513 - DNA, 511 bp, Homo sapiens
  misc_feature: HIJSMM301ADDEB.51.86.H09.1.454.light.4.raw
cgatcgtatacacgaccggtgctcgatttagtgctatagacttgggtttggggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtaggaaatcaaacgaactagtggctgcaccatctgtcttcta

SEQ ID NO: 543514 - DNA, 484 bp, Homo sapiens; identical to SEQ ID NO: 535400
  misc_feature: HIJSMM301CBHDV.46.26.C04.1.454.light.4.raw

SEQ ID NO: 543515 - DNA, 518 bp, Homo sapiens
  misc_feature: HIJSMM301BYWOF.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctgttcccaccctcctcactactca

SEQ ID NO: 543516 - DNA, 486 bp, Homo sapiens; identical to SEQ ID NO: 536553
  misc_feature: HIJSMM301DSUQL.17.34.D01.1.454.light.4.raw

SEQ ID NO: 543517 - DNA, 504 bp, Homo sapiens
  misc_feature: HIJSMM301B8OQ8.48.86.H09.1.454.light.4.raw
agtatacatacacgaccggtgctcgatttagtgctatagacttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 543518 - DNA, 488 bp, Homo sapiens; identical to SEQ ID NO: 539612
  misc_feature: HIJSMM301BCKC0.3.55.E11.1.454.light.4.raw

SEQ ID NO: 543519 - DNA, 494 bp, Homo sapiens; identical to SEQ ID NO: 534994
  misc_feature: HIJSMM301ETWKY.27.78.H01.1.454.light.4.raw

SEQ ID NO: 543520 - DNA, 494 bp, Homo sapiens
  misc_feature: HIJSMM301AQGDS.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaaaacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcgaagggaccaaggtggagatcaaacgaactgtgg

SEQ ID NO: 543521 - DNA, 519 bp, Homo sapiens; identical to SEQ ID NO: 541911
  misc_feature: HIJSMM301C4QY7.27.23.C01.1.454.light.4.raw

SEQ ID NO: 543522 - DNA, 495 bp, Homo sapiens; identical to SEQ ID NO: 535712
  misc_feature: HIJSMM301ANKJP.27.78.H01.1.454.light.4.raw

SEQ ID NO: 543523 - DNA, 510 bp, Homo sapiens
  misc_feature: HIJSMM301EAIKT.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggacggaacagtgaggatcaaccgaaaccgtgttggcggtctcgacccaactcttcgttcg

SEQ ID NO: 543524 - DNA, 492 bp, Homo sapiens; identical to SEQ ID NO: 536010
  misc_feature: HIJSMM301EDJPL.10.20.B09.1.454.light.4.raw

SEQ ID NO: 543525 - DNA, 494 bp, Homo sapiens
  misc_feature: HIJSMM301BO2MM.18.59.F04.1.454.light.4.raw
tacgagtatgcacgaccggtgctcgatttagtacacacacttagggattgggggctggggtctcaggaggcagcgcgctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacatggcctccctgaccatctctgggctccaggctgaggacgaggctgattattactgcagctcatatacaagcaccagcactctctatgtcttcggaactgggaccaaggtcacgtcctaggtcagcccaa

SEQ ID NO: 543526 - DNA, 502 bp, Homo sapiens; identical to SEQ ID NO: 535463
  misc_feature: HIJSMM301A2G8B.43.86.H09.1.454.light.4.raw

SEQ ID NO: 543527 - DNA, 490 bp, Homo sapiens
  misc_feature: HIJSMM301CY4WY.49.55.E11.1.454.light.4.raw
agtcgagagacacgaccggtgctcgatttagcactcgcacgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctggggacagagttcactctcaccatcagcagcctgcagtctgaagattttgcagtttattactgtcagcagtataatgtccgggctccggacactttcggcggagggaccaaggtggagatcaaacgaactgtggctgcaccat

SEQ ID NO: 543528 - DNA, 486 bp, Homo sapiens; identical to SEQ ID NO: 535043
  misc_feature: HIJSMM301B9MSS.46.35.D02.1.454.light.4.raw

SEQ ID NO: 543529 - DNA, 501 bp, Homo sapiens; identical to SEQ ID NO: 535746
  misc_feature: HIJSMM301EKRRJ.18.11.A11.1.454.light.4.raw

SEQ ID NO: 543530 - DNA, 496 bp, Homo sapiens
  misc_feature: HIJSMM301BCKHM.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatcctatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccagactgtaggagtacaacgaaacgtacgtggcgtgcgaccact

SEQ ID NO: 543531 - DNA, 485 bp, Homo sapiens; identical to SEQ ID NO: 535501
  misc_feature: HIJSMM301CXW83.3.10.A10.1.454.light.4.raw

SEQ ID NO: 543532 - DNA, 512 bp, Homo sapiens
  misc_feature: HIJSMM301AZ8LP.40.53.E09.1.454.light.4.raw
tctagcgactcacgaccggtgctcgatttagagagagtgtgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgttccg

SEQ ID NO: 543533 - DNA, 504 bp, Homo sapiens
  misc_feature: HIJSMM301ELHN0.48.58.F03.1.454.light.4.raw
agtatacatacacgaccggtgctcgatttagtctgatcgagaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctcgtcggggtcccctcgaggttcagtggcagtggatctgggacagatttcaccctcaccatcaatagcctggaagctgaagatgctgcaaccttattactgtcatcagactttttagttacgtcggaccttcggccgaaggacacgactggagaattaaacgaactgtggctgcaccatctgttcttcatccttcccg

SEQ ID NO: 543534 - DNA, 390 bp, Homo sapiens
  misc_feature: HIJSMM301ENANB.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccgtgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccgccctcctccgagcgacga

SEQ ID NO: 543535 - DNA, 494 bp, Homo sapiens
  misc_feature: HIJSMM301BVYFK.16.78.H01.1.454.light.4.raw
tgtactactccacgaccggtgctcgatttagtgtgagtagtttgggtttggggaggaactgctcagttaggacccagacggaaccatggaagccccacgcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatct

SEQ ID NO: 543536 - DNA, 514 bp, Homo sapiens
  misc_feature: HIJSMM301CDAFZ.17.33.C11.1.454.light.4.raw
cgtagactagcacgaccggtgctcgatttagagtgagctcgttgggtttgggggtcgtggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctcgccccctggtcactctcgttccca

SEQ ID NO: 543537 - DNA, 493 bp, Homo sapiens; identical to SEQ ID NO: 535047
  misc_feature: HIJSMM301EICGP.16.53.E09.1.454.light.4.raw

SEQ ID NO: 543538 - DNA, 497 bp, Homo sapiens
  misc_feature: HIJSMM301BSKK8.22.86.H09.1.454.light.4.raw
  modified_base (489)..(489): a, c, t, g, unknown or other
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccncctcctcg

SEQ ID NO: 543539 - DNA, 483 bp, Homo sapiens
  misc_feature: HIJSMM301CZLX8.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacttcggccagggacacgactggagattaaacgaactgtggctgcaccatctgt

SEQ ID NO: 543540 - DNA, 505 bp, Homo sapiens
  misc_feature: HIJSMM301D0OH6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatacaaacgaactagtggctgcaccatctgtcttcatcttccccg

SEQ ID NO: 543541 - DNA, 500 bp, Homo sapiens
  misc_feature: HIJSMM301DWNO1.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaacccactgtcta

SEQ ID NO: 543542 - DNA, 520 bp, Homo sapiens
  misc_feature: HIJSMM301CLDQ8.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccaccct

SEQ ID NO: 543543 - DNA, 486 bp, Homo sapiens
  misc_feature: HIJSMM301DQYQX.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaactgtggctgcaccatctgt

SEQ ID NO: 543544 - DNA, 487 bp, Homo sapiens; identical to SEQ ID NO: 537573
  misc_feature: HIJSMM301DT4OB.3.10.A10.1.454.light.4.raw

SEQ ID NO: 543545 - DNA, 485 bp, Homo sapiens; identical to SEQ ID NO: 536075
  misc_feature: HIJSMM301CITCL.17.21.B10.1.454.light.4.raw

SEQ ID NO: 543546 - DNA, 507 bp, Homo sapiens
  misc_feature: HIJSMM301A7RFN.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttgggtgttcggcggagggaccaagttgaccgtcctaggtcagcccaaggctgccccctcggtcactctgtt

SEQ ID NO: 543547 - DNA, 500 bp, Homo sapiens; identical to SEQ ID NO: 542309
  misc_feature: HIJSMM301CZNLQ.12.86.H09.1.454.light.4.raw

SEQ ID NO: 543548 - DNA, 485 bp, Homo sapiens
  misc_feature: HIJSMM301BFELC.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcgagggaccaaggtggagatcaaacgaactgtggctgcaccatctgtcttcatt

SEQ ID NO: 543549 - DNA, 444 bp, Homo sapiens; identical to SEQ ID NO: 535027
  misc_feature: HIJSMM301A4EL2.8.73.G07.1.454.light.4.raw

SEQ ID NO: 543550 - DNA, 464 bp, Homo sapiens; identical to SEQ ID NO: 536640
  misc_feature: HIJSMM301A5Q9U.26.78.H01.1.454.light.4.raw

SEQ ID NO: 543551 - DNA, 487 bp, Homo sapiens
  misc_feature: HIJSMM301BXUDR.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 543552 - DNA, 485 bp, Homo sapiens; identical to SEQ ID NO: 538533
  misc_feature: HIJSMM301D1FMA.47.78.H01.1.454.light.4.raw

SEQ ID NO: 543553 - DNA, 491 bp, Homo sapiens; identical to SEQ ID NO: 541413
  misc_feature: HIJSMM301CFRCQ.14.28.C06.1.454.light.4.raw

SEQ ID NO: 543554 - DNA, 493 bp, Homo sapiens
  misc_feature: HIJSMM301CD2LT.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactgtggctgcaccactctgtt

SEQ ID NO: 543555 - DNA, 457 bp, Homo sapiens
  misc_feature: HIJSMM301EZU1A.49.83.H06.1.454.light.4.raw
agtcgagagacacgaccggtgctcgatttagatcacgtgcgtcgcgggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaattgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgaggctgactattactgtcaggcgtgggacagccgcactgggggtattcggcggagggaccaagctgaccgt

SEQ ID NO: 543556 - DNA, 489 bp, Homo sapiens; identical to SEQ ID NO: 536013
  misc_feature: HIJSMM301BX2TD.26.23.C01.1.454.light.4.raw

SEQ ID NO: 543557 - DNA, 493 bp, Homo sapiens
  misc_feature: HIJSMM301EU2VP.21.27.C05.1.454.light.4.raw
tcgtcgctcgcacgaccggtgctcgatttagacgcgatcgaagggtttgggggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtcttc

SEQ ID NO: 543558 - DNA, 444 bp, Homo sapiens; identical to SEQ ID NO: 534993
  misc_feature: HIJSMM301A7GMM.5.9.A09.1.454.light.4.raw

SEQ ID NO: 543559 - DNA, 487 bp, Homo sapiens; identical to SEQ ID NO: 537220
  misc_feature: HIJSMM301BNNWI.16.53.E09.1.454.light.4.raw

SEQ ID NO: 543560 - DNA, 477 bp, Homo sapiens
  misc_feature: HIJSMM301BI59B.41.12.B01.1.454.light.4.raw
tctatactatcacgaccggtgctcgatttagtagtgtagattccgcgggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtggggtcccatcaaggttcagcggcagtggatctggcacagatttcactctcaccatcagcagcctgcagcctgaagattttgcaacttattactgtctacaagattacaattaccctcgacttttgccagggaccaggctggagatcaaacgaactgtggctgcacca

SEQ ID NO: 543561 - DNA, 444 bp, Homo sapiens; identical to SEQ ID NO: 535411
  misc_feature: HIJSMM301DEM09.8.73.G07.1.454.light.4.raw

SEQ ID NO: 543562 - DNA, 501 bp, Homo sapiens
  misc_feature: HIJSMM301EWW2T.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaacgaactgtggctgcaccatctgtcttcat

SEQ ID NO: 543563 - DNA, 508 bp, Homo sapiens
  misc_feature: HIJSMM301AV2OG.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctccggtcacctctgtttcccaccctcctcctacgtcgtat

SEQ ID NO: 543564 - DNA, 487 bp, Homo sapiens; identical to SEQ ID NO: 541729
  misc_feature: HIJSMM301BBPMA.40.83.H06.1.454.light.4.raw

SEQ ID NO: 543565 - DNA, 495 bp, Homo sapiens
  misc_feature: HIJSMM301C7VVC.53.81.H04.1.454.light.4.raw
cgcgtatacacacgaccggtgctcgatttagtagtgtagattcgcgggcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaagg

SEQ ID NO: 543566 - DNA, 494 bp, Homo sapiens; identical to SEQ ID NO: 535276
  misc_feature: HIJSMM301CURXI.16.6.A06.1.454.light.4.raw

SEQ ID NO: 543567 - DNA, 446 bp, Homo sapiens
  misc_feature: HIJSMM301AZ9EM.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacaagcattcggccctccaggggtcccgtgaccgattctctggttccttgtctgacacctcagcctccctggccatcactgggctccagcctgaggatgaggctgattattactgtcagtcctttgacattaaactggatgtggtattcggcggaggtacccacgtaaccgtcctaggtcagcccaaggctcgccccctccggtcactctgttcccgccctcctcgtatctctcg

SEQ ID NO: 543568 - DNA, 494 bp, Homo sapiens; identical to SEQ ID NO: 534994
  misc_feature: HIJSMM301B72NN.27.78.H01.1.454.light.4.raw

SEQ ID NO: 543569 - DNA, 505 bp, Homo sapiens
  misc_feature: HIJSMM301DSJS7.10.12.B01.1.454.light.4.raw
catagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcggagggtccaagctgaccgtcctaggtcagcccaaggctgccccctcggtcactctgttccca

SEQ ID NO: 543570 - DNA, 495 bp, Homo sapiens
  misc_feature: HIJSMM301EEE16.9.53.E09.1.454.light.4.raw
tgatacgtctcacgaccggtgctcgatttagagagagtgtgttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtgaccgtcctaggtcagcccaaggctgccccctc

SEQ ID NO: 543571 - DNA, 492 bp, Homo sapiens
  misc_feature: HIJSMM301A03IG.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccagggaccaagctggagatcaagcgaactgtggctgcaccatctgtcttcta

SEQ ID NO: 543572 - DNA, 506 bp, Homo sapiens; identical to SEQ ID NO: 536464
  misc_feature: HIJSMM301AJCQC.9.55.E11.1.454.light.4.raw

SEQ ID NO: 543573 - DNA, 469 bp, Homo sapiens
  misc_feature: HIJSMM301DNG52.52.59.F04.1.454.light.4.raw
  modified_base (430)..(430): a, c, t, g, unknown or other
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctnacacgttcggccaagggaccaagctggaaatcaaacgaa

SEQ ID NO: 543574 - DNA, 498 bp, Homo sapiens
  misc_feature: HIJSMM301BGHST.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcaggaccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgcc

SEQ ID NO: 543575 - DNA, 447 bp, Homo sapiens
  misc_feature: HIJSMM301APB5G.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggcagactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 543576 - DNA, 486 bp, Homo sapiens
  misc_feature: HIJSMM301B2G66.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtgaggctgaggatgttggggtttattactgcatgcaagttctacaaacttcctacacttttggccaggggaccaagctggagatcaaacgaa

SEQ ID NO: 543577 - DNA, 494 bp, Homo sapiens; identical to SEQ ID NO: 534992
  misc_feature: HIJSMM301DSVGQ.9.1.A01.1.454.light.4.raw

SEQ ID NO: 543578 - DNA, 493 bp, Homo sapiens; identical to SEQ ID NO: 535657
  misc_feature: HIJSMM301CJ786.27.78.H01.1.454.light.4.raw

SEQ ID NO: 543579 - DNA, 497 bp, Homo sapiens
  misc_feature: HIJSMM301CUHRI.52.53.E09.1.454.light.4.raw
cgcagtacgacacgaccggtgctcgatttagagagagtgtgttgggtttgggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaaacgaactgtggctgcaccatctgtcttcatcttccg

SEQ ID NO: 543580 - DNA, 493 bp, Homo sapiens
  misc_feature: HIJSMM301CFG5I.51.71.G05.1.454.light.4.raw
cgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcta

SEQ ID NO: 543581 - DNA, 477 bp, Homo sapiens
  misc_feature: HIJSMM301BVLRA.17.50.E06.1.454.light.4.raw
cgtagactagcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcaggccattagcagctatttaaattggtatcagcagaaaccagggaaagcccctaagctcctgatctatgctgcatccagtttgcaaagtggggtcccattaaggttcagtggcagtggatctggacagatttcactctcaccatcagcagtctgcaacctgaagattttgcaacttactcctgtcaacagagttacagtaccccgttcacttttggccaggggaccaagctggagatcaaacgaactgt

SEQ ID NO: 543582 - DNA, 468 bp, Homo sapiens
  misc_feature: HIJSMM301CF5KU.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctcgcagcctgaagatattgcaacatattactgtcagcagtatgataatctcccgatcaccttcggccaagggacaacgactggagattaaacgaa

SEQ ID NO: 543583 - DNA, 497 bp, Homo sapiens; identical to SEQ ID NO: 535740
  misc_feature: HIJSMM301BA3DH.3.71.G05.1.454.light.4.raw

SEQ ID NO: 543584 - DNA, 525 bp, Homo sapiens
  misc_feature: HIJSMM301EASOY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaaacctagtggcgtgcaccatctgtcttctatcttcccgtcccactctg

SEQ ID NO: 543585 - DNA, 515 bp, Homo sapiens
  misc_feature: HIJSMM301DRYWH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccgaagggaccgaaggtaggaaggtacgaaacgaactagtggctgcaccatctgtcttctactcttcccgccact

SEQ ID NO: 543586 - DNA, 507 bp, Homo sapiens
  misc_feature: HIJSMM301C2BTN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtggaaagtacaaacgaactagtggctgcaccatctgtcttcatcttccccg

SEQ ID NO: 543587 - DNA, 508 bp, Homo sapiens
  misc_feature: HIJSMM301DN4Q6.17.33.C11.1.454.light.4.raw
cgtagactagcacgaccggtgctcgatttagagtgagctcgttgggtttggggctggcgccaggggtcccttccaatatcagcaccatagcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccg

SEQ ID NO: 543588 - DNA, 499 bp, Homo sapiens
  misc_feature: HIJSMM301BRFW1.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccgccctcctccacgagagta

SEQ ID NO: 543589 - DNA, 503 bp, Homo sapiens
  misc_feature: HIJSMM301EW5HO.48.34.D01.1.454.light.4.raw
agtatacatacacgaccggtgctcgatttagatcgtctgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggccctgggaccaaataaatagtcaatcgaactgtggctgcaccatctgtcttctat

SEQ ID NO: 543590 - DNA, 508 bp, Homo sapiens
  misc_feature: HIJSMM301DLP6S.43.67.G01.1.454.light.4.raw
  modified_base (493)..(493): a, c, t, g, unknown or other
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaatcaaacgaactagtggntgcaccatctgtctt

SEQ ID NO: 543591 - DNA, 506 bp, Homo sapiens
  misc_feature: HIJSMM301A5M2H.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacgaccaccctgaccatcagcagggtcgaagccgggatgaggccgactattactgtcaggtgtgggatagtagtggtgatcatccatacgtcttcggaactgggaccaaggtctcgtcctacgtcagcccaaggccaacccactgtcactctgttccca

SEQ ID NO: 543592 - DNA, 478 bp, Homo sapiens
  misc_feature: HIJSMM301BN87F.49.26.C04.1.454.light.4.raw
agtcgagagacacgaccggtgctcgatttagtctagcgactttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgcacca

SEQ ID NO: 543593 - DNA, 486 bp, Homo sapiens; identical to SEQ ID NO: 536329
  misc_feature: HIJSMM301EJT4F.21.4.A04.1.454.light.4.raw

SEQ ID NO: 543594 - DNA, 502 bp, Homo sapiens; identical to SEQ ID NO: 540270
  misc_feature: HIJSMM301BINQQ.27.78.H01.1.454.light.4.raw

SEQ ID NO: 543595 - DNA, 460 bp, Homo sapiens; identical to SEQ ID NO: 540069
  misc_feature: HIJSMM301CIXJO.11.86.H09.1.454.light.4.raw

SEQ ID NO: 543596 - DNA, 490 bp, Homo sapiens
  misc_feature: HIJSMM301A26SD.27.78.H01.1.454.light.4.raw
  modified_base (427)..(427): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttatactgtcatcagagtactactttaccncaagtgatcaccttcggccaagggcacgactggagattaacgaactgtggctgcaccatctgt

SEQ ID NO: 543597 - DNA, 502 bp, Homo sapiens
  misc_feature: HIJSMM301EF3BA.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgt

SEQ ID NO: 543598 - DNA, 505 bp, Homo sapiens; identical to SEQ ID NO: 536254
  misc_feature: HIJSMM301EQ2PY.7.71.G05.1.454.light.4.raw

SEQ ID NO: 543599 - DNA, 513 bp, Homo sapiens
  misc_feature: HIJSMM301BE5KG.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccgccctcct

SEQ ID NO: 543600 - DNA, 499 bp, Homo sapiens
  misc_feature: HIJSMM301ET42E.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaactgtggctgcaccatctgtcttcta

SEQ ID NO: 543601 - DNA, 507 bp, Homo sapiens
  misc_feature: HIJSMM301CBX9X.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacatattttaccctcaccatcaggggtctacagcctgaagattttgcgacttactattgtcaacagagttaccttctcccccggacgtcgtccacggacgaacggtaggaagtacaagacgaacagtaggcgtgcaccacactgtcttctatcttccgt

SEQ ID NO: 543602 - DNA, 490 bp, Homo sapiens; identical to SEQ ID NO: 538714
  misc_feature: HIJSMM301D17WT.11.12.B01.1.454.light.4.raw

SEQ ID NO: 543603 - DNA, 486 bp, Homo sapiens; identical to SEQ ID NO: 535043
  misc_feature: HIJSMM301AP3A3.46.35.D02.1.454.light.4.raw

SEQ ID NO: 543604 - DNA, 499 bp, Homo sapiens
  misc_feature: HIJSMM301DWK5Z.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaacgaactgtggctgcaccatctgtcttcatt

SEQ ID NO: 543605 - DNA, 490 bp, Homo sapiens; identical to SEQ ID NO: 536855
  misc_feature: HIJSMM301BOS1G.16.68.G02.1.454.light.4.raw

SEQ ID NO: 543606 - DNA, 508 bp, Homo sapiens
  misc_feature: HIJSMM301CHMP6.14.7.A07.1.454.light.4.raw
  modified_base (475)..(475): a, c, t, g, unknown or other
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggnggagggacccaggtgaccgtcctacgtcagccc

SEQ ID NO: 543607 - DNA, 444 bp, Homo sapiens; identical to SEQ ID NO: 535594
  misc_feature: HIJSMM301ASS7Y.9.9.A09.1.454.light.4.raw

SEQ ID NO: 543608 - DNA, 486 bp, Homo sapiens; identical to SEQ ID NO: 536323
  misc_feature: HIJSMM301CYVZW.10.2.A02.1.454.light.4.raw

SEQ ID NO: 543609 - DNA, 490 bp, Homo sapiens; identical to SEQ ID NO: 540409
  misc_feature: HIJSMM301BHMR1.15.8.A08.1.454.light.4.raw

SEQ ID NO: 543610 - DNA, 474 bp, Homo sapiens
  misc_feature: HIJSMM301C4DHM.52.19.B08.1.454.light.4.raw
cgcagtacgacacgaccggtgctcgatttagtgagtcagtaagggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcgcgggggaccaaggtggagatcaagcgaactgtggctgcacca

SEQ ID NO: 543611 - DNA, 485 bp, Homo sapiens
  misc_feature: HIJSMM301AOK9M.51.58.F03.1.454.light.4.raw
  modified_base (466)..(466): a, c, t, g, unknown or other
  modified_base (468)..(468): a, c, t, g, unknown or other
cgatcgtatacacgaccggtgctcgatttagtctgatcgagaagggaaaggggagtcagtcccaacccaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaattataacagggccgttgcgctcactttcggtcggggaccggaacgtaggaggananacgagacgtagtggtcg

SEQ ID NO: 543612 - DNA, 497 bp, Homo sapiens
  misc_feature: HIJSMM301CUKD3.22.27.C05.1.454.light.4.raw
acatacgcgtcacgaccggtgctcgatttagacgcgatcgaagggtttggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 543613 - DNA, 496 bp, Homo sapiens
  misc_feature: HIJSMM301CAUV3.26.12.B01.1.454.light.4.raw
agactatactcacgaccggtgctcgatttagtagtgtagattccgcgggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccgaagctggagatcaaccgaactgtggctgcaccatctgtcttcatcttcccg

SEQ ID NO: 543614 - DNA, 454 bp, Homo sapiens; identical to SEQ ID NO: 534964
  misc_feature: HIJSMM301C8CKU.19.86.H09.1.454.light.4.raw

SEQ ID NO: 543615 - DNA, 504 bp, Homo sapiens
  misc_feature: HIJSMM301BGYLF.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcact

SEQ ID NO: 543616 - DNA, 504 bp, Homo sapiens
  misc_feature: HIJSMM301DKJEG.48.27.C05.1.454.light.4.raw
agtatacatacacgaccggtgctcgatttagacgcgatcgaagggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgcc

SEQ ID NO: 543617 - DNA, 486 bp, Homo sapiens; identical to SEQ ID NO: 535043
  misc_feature: HIJSMM301D4K5M.46.35.D02.1.454.light.4.raw

SEQ ID NO: 543618 - DNA, 485 bp, Homo sapiens
  misc_feature: HIJSMM301CPGDQ.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagtcggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaac

SEQ ID NO: 543619 - DNA, 501 bp, Homo sapiens
  misc_feature: HIJSMM301DS3GL.48.16.B05.1.454.light.4.raw
agtatacatacacgaccggtgctcgatttagagctcacgtaaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgctttttgttcggcggagggaccaaactgaccgtcctcggtcggcccaaggctgccccctcggtcact

SEQ ID NO: 543620 - DNA, 485 bp, Homo sapiens; identical to SEQ ID NO: 535606
  misc_feature: HIJSMM301CPQLG.47.46.E02.1.454.light.4.raw

SEQ ID NO: 543621 - DNA, 404 bp, Homo sapiens
  misc_feature: HIJSMM301C38AB.52.83.H06.1.454.light.4.raw
cgcagtacgacacgaccggtgctcgatttagatcacgtgcgtcgcggggcgggggcacttctccctctaacactctcccctgttgaagctctttgtgacgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtggctgcaccatctgtcttcatcttcccgccatctgatatacgatcg

SEQ ID NO: 543622 - DNA, 491 bp, Homo sapiens; identical to SEQ ID NO: 540646
  misc_feature: HIJSMM301ATKF5.14.55.E11.1.454.light.4.raw

SEQ ID NO: 543623 - DNA, 494 bp, Homo sapiens
  misc_feature: HIJSMM301AYM3K.5.35.D02.1.454.light.4.raw
atcagacacgcacgaccggtgctcgatttagcacacgatagttgggtttgggggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtcttcta

SEQ ID NO: 543624 - DNA, 492 bp, Homo sapiens
  misc_feature: HIJSMM301DUAGE.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctcgggtccgaaacgtaggaggatcaaacgaaactagtgg

SEQ ID NO: 543625 - DNA, 500 bp, Homo sapiens
  misc_feature: HIJSMM301DPWOK.41.22.B11.1.454.light.4.raw
tctatactatcacgaccggtgctcgatttagacgacagctcaggggagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgggacagacttcactctctccatcagcagactggagcctgaagattttgcaatttattactgtcaccagtatggtagttcacctctaactttcggcggagggaccgaaggtggagatacaaacgaactgtggctgcaccatctgtcttcatcttccccg

SEQ ID NO: 543626 - DNA, 495 bp, Homo sapiens
  misc_feature: HIJSMM301CXHDJ.40.71.G05.1.454.light.4.raw
tctagcgactcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcct

SEQ ID NO: 543627 - DNA, 496 bp, Homo sapiens
  misc_feature: HIJSMM301D4ZX0.16.53.E09.1.454.light.4.raw
tgtactactccacgaccggtgctcgatttagagagagtgtgttgggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttactactgaaaatacagcagagtggaggctgaggatgttggggtttattactgcatgcaagctctacaaactaccttacactttggtccagggaccgaagctggagatcaaacgaactgtggc

SEQ ID NO: 543628 - DNA, 494 bp, Homo sapiens
  misc_feature: HIJSMM301EU1P1.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcgtccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgca

SEQ ID NO: 543629 - DNA, 488 bp, Homo sapiens; identical to SEQ ID NO: 537527
  misc_feature: HIJSMM301BVSR5.26.78.H01.1.454.light.4.raw

SEQ ID NO: 543630 - DNA, 490 bp, Homo sapiens; identical to SEQ ID NO: 536855
  misc_feature: HIJSMM301BLXAL.16.68.G02.1.454.light.4.raw

SEQ ID NO: 543631 - DNA, 495 bp, Homo sapiens
  misc_feature: HIJSMM301EBNIG.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccca

SEQ ID NO: 543632 - DNA, 447 bp, Homo sapiens; identical to SEQ ID NO: 535020
  misc_feature: HIJSMM301AMMU2.18.9.A09.1.454.light.4.raw

SEQ ID NO: 543633 - DNA, 506 bp, Homo sapiens
  misc_feature: HIJSMM301BGE95.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcacttcggtcggagggaccgaacggttaggtaggatacaaaccgaaacctagttgggcgtcgacacccaa

SEQ ID NO: 543634 - DNA, 478 bp, Homo sapiens; identical to SEQ ID NO: 535129
  misc_feature: HIJSMM301EXJ25.11.11.A11.1.454.light.4.raw

SEQ ID NO: 543635 - DNA, 444 bp, Homo sapiens; identical to SEQ ID NO: 535594
  misc_feature: HIJSMM301EJ2F8.9.9.A09.1.454.light.4.raw

SEQ ID NO: 543636 - DNA, 499 bp, Homo sapiens
  misc_feature: HIJSMM301CFMJ3.48.30.C08.1.454.light.4.raw
agtatacatacacgaccggtgctcgatttagtctgacgtcaaagggaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggaggattaacgaactgtggctgcaccatctgtcttcatcttcccgcc

SEQ ID NO: 543637 - DNA, 383 bp, Homo sapiens; identical to SEQ ID NO: 447524
  misc_feature: HIJSMM301ALIFW.41.26.C04.1.454.light.4.raw

SEQ ID NO: 543638 - DNA, 447 bp, Homo sapiens; identical to SEQ ID NO: 535020
  misc_feature: HIJSMM301BEHBA.18.9.A09.1.454.light.4.raw

SEQ ID NO: 543639 - DNA, 496 bp, Homo sapiens
  misc_feature: HIJSMM301DFMV2.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctggcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtctt

SEQ ID NO: 543640 - DNA, 504 bp, Homo sapiens
  misc_feature: HIJSMM301C0ZPV.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtcttcgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtt

SEQ ID NO: 543641 - DNA, 494 bp, Homo sapiens; identical to SEQ ID NO: 534994
  misc_feature: HIJSMM301E0ZOW.27.78.H01.1.454.light.4.raw

SEQ ID NO: 543642 - DNA, 447 bp, Homo sapiens; identical to SEQ ID NO: 541817
  misc_feature: HIJSMM301C2PSH.18.9.A09.1.454.light.4.raw

SEQ ID NO: 543643 - DNA, 485 bp, Homo sapiens
  misc_feature: HIJSMM301A9QR9.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatacaaacgaactagtggctgcaccatctgtcttcta

SEQ ID NO: 543644 - DNA, 483 bp, Homo sapiens; identical to SEQ ID NO: 542318
  misc_feature: HIJSMM301A5V78.13.59.F04.1.454.light.4.raw

SEQ ID NO: 543645 - DNA, 510 bp, Homo sapiens
  misc_feature: HIJSMM301CZBC9.52.67.G01.1.454.light.4.raw
cgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtggaggctgaggatgttggggtttatactgcatgcaaggtacacactggcctccgacgttcggccaagggaccaaggtggaaatcaaacgaactgtggctgcaccatctgtcttcta

SEQ ID NO: 543646 - DNA, 483 bp, Homo sapiens
  misc_feature: HIJSMM301DNR57.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatat

SEQ ID NO: 543647 - DNA, 499 bp, Homo sapiens
  misc_feature: HIJSMM301AK8KX.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaacggtaggatatcagacgaactagtggctg

SEQ ID NO: 543648 - DNA, 486 bp, Homo sapiens; identical to SEQ ID NO: 537617
  misc_feature: HIJSMM301BHT5U.10.53.E09.1.454.light.4.raw

SEQ ID NO: 543649 - DNA, 447 bp, Homo sapiens; identical to SEQ ID NO: 535201
  misc_feature: HIJSMM301ENN0M.18.9.A09.1.454.light.4.raw

SEQ ID NO: 543650 - DNA, 479 bp, Homo sapiens; identical to SEQ ID NO: 535118
  misc_feature: HIJSMM301BS1IS.13.59.F04.1.454.light.4.raw

SEQ ID NO: 543651 - DNA, 484 bp, Homo sapiens
  misc_feature: HIJSMM301C55O9.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaagtggagatcaaacgaa

SEQ ID NO: 543652 - DNA, 467 bp, Homo sapiens; identical to SEQ ID NO: 538403
  misc_feature: HIJSMM301C5O8V.41.48.E04.1.454.light.4.raw

SEQ ID NO: 543653 - DNA, 490 bp, Homo sapiens
  misc_feature: HIJSMM301A4T9L.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcgccaaggaccaagtaggacgatcaagcgaactgtggctgcaccatctgtt

SEQ ID NO: 543654 - DNA, 499 bp, Homo sapiens
  misc_feature: HIJSMM301B1XI0.43.55.E11.1.454.light.4.raw
tgtgagtagtcacgaccggtgctcgatttagcactcgcacgttgggtttggggagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaagggaccaacgtggaaatacaaacgaactagtggctgcaccatctgtcttctatcttcccg

SEQ ID NO: 543655 - DNA, 521 bp, Homo sapiens
  misc_feature: HIJSMM301CW6AW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaaggaccgaacggtaggaaggtacaaacgaaactagtggcgtgcaccactctgtcttctatcttcccgtccactctcgat

SEQ ID NO: 543656 - DNA, 511 bp, Homo sapiens
  misc_feature: HIJSMM301AEGT4.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcgctacgt

SEQ ID NO: 543657 - DNA, 454 bp, Homo sapiens; identical to SEQ ID NO: 536449
  misc_feature: HIJSMM301B8CXB.18.78.H01.1.454.light.4.raw

SEQ ID NO: 543658 - DNA, 503 bp, Homo sapiens
  misc_feature: HIJSMM301AROEG.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggccccaaaattggtcatctatgaagacgacaaacgaccctccgggatccctgagagattctctggctccagctcagggactatggccaccttgactatcagtgggcccgaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 543659 - DNA, 487 bp, Homo sapiens; identical to SEQ ID NO: 538190
  misc_feature: HIJSMM301BCGLW.47.70.G04.1.454.light.4.raw

SEQ ID NO: 543660 - DNA, 383 bp, Homo sapiens
  misc_feature: HIJSMM301B725X.41.37.D04.1.454.light.4.raw
tctatactatcacgaccggtgctcgatttagtagcatactgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 543661 - DNA, 508 bp, Homo sapiens; identical to SEQ ID NO: 536388
  misc_feature: HIJSMM301D7335.11.57.F02.1.454.light.4.raw

SEQ ID NO: 543662 - DNA, 497 bp, Homo sapiens
  misc_feature: HIJSMM301ENFW8.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctccaggaggtccctcgatcgattctctggctccaagtctggcaacacggcctccctgaacatctctgggcgtccaggctgaggagtgaggctgattattattgctgctcatatggaagtacctactcttttctctcggactggcaccgtcgacctcctaggtcagcccaacggccaacccca

SEQ ID NO: 543663 - DNA, 443 bp, Homo sapiens
  misc_feature: HIJSMM301DPRNK.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctggtcactctgttcccaccctcctctgtcgagcgt

SEQ ID NO: 543664 - DNA, 510 bp, Homo sapiens
  misc_feature: HIJSMM301BXECO.48.25.C03.1.454.light.4.raw
agtatacatacacgaccggtgctcgatttagtagtgtagatttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccca

SEQ ID NO: 543665 - DNA, 490 bp, Homo sapiens
  misc_feature: HIJSMM301CJ3RO.47.52.E08.1.454.light.4.raw
agctcacgtacacgaccggtgctcgatttagtcgagctctcagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaagggaccgaacggtggaaagtacaaacgaactacgtggctgcacca

SEQ ID NO: 543666 - DNA, 513 bp, Homo sapiens; identical to SEQ ID NO: 535244
  misc_feature: HIJSMM301AYJQA.17.33.C11.1.454.light.4.raw

SEQ ID NO: 543667 - DNA, 518 bp, Homo sapiens
  misc_feature: HIJSMM301DU18P.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactcgtcactctcgttcccgccctcct

SEQ ID NO: 543668 - DNA, 445 bp, Homo sapiens
  misc_feature: HIJSMM301BYHNL.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccacctcctccatactcgta

SEQ ID NO: 543669 - DNA, 472 bp, Homo sapiens
  misc_feature: HIJSMM301C73JF.52.59.F04.1.454.light.4.raw
  modified_base (362)..(362): a, c, t, g, unknown or other
  modified_base (408)..(408): a, c, t, g, unknown or other
  modified_base (433)..(433): a, c, t, g, unknown or other
cgcagtacgacacgaccggtgctcgatttagtacacacacttagggattggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcagggtcccatctcggttcgttggcagtgggtctgggacagattttacnctcaccatcagcagcctgcagcctgaagatgttgcaacttatttcngtcataactatgatgatgccccctnacacgttcggccaagggaccaagctggaaatcaaacgaa

SEQ ID NO: 543670 - DNA, 464 bp, Homo sapiens
  misc_feature: HIJSMM301AWGXA.51.16.B05.1.454.light.4.raw
cgatcgtatacacgaccggtgctcgatttagagctcacgtaaggggaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatctcttgccaggcgagtcaggacattataagatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaggatcttgcaacatattactgtcaacagtatgataatgtcccgtacacttttggccaggggaccaagctggagatcagacgaa

SEQ ID NO: 543671 - DNA, 448 bp, Homo sapiens; identical to SEQ ID NO: 540567
  misc_feature: HIJSMM301AILMN.18.9.A09.1.454.light.4.raw

SEQ ID NO: 543672 - DNA, 497 bp, Homo sapiens; identical to SEQ ID NO: 535286
  misc_feature: HIJSMM301B5DYC.18.59.F04.1.454.light.4.raw

SEQ ID NO: 543673 - DNA, 480 bp, Homo sapiens; identical to SEQ ID NO: 535291
  misc_feature: HIJSMM301DAHIQ.22.59.F04.1.454.light.4.raw

SEQ ID NO: 543674 - DNA, 488 bp, Homo sapiens; identical to SEQ ID NO: 535725
  misc_feature: HIJSMM301A5T5N.12.88.H11.1.454.light.4.raw

SEQ ID NO: 543675 - DNA, 473 bp, Homo sapiens; identical to SEQ ID NO: 535262
  misc_feature: HIJSMM301D907I.8.67.G01.1.454.light.4.raw

SEQ ID NO: 543676 - DNA, 501 bp, Homo sapiens
  misc_feature: HIJSMM301A6JL1.48.34.D01.1.454.light.4.raw
agtatacatacacgaccggtgctcgatttagatcgtctgtgttgggtttgggggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcattcttcccgc

SEQ ID NO: 543677 - DNA, 511 bp, Homo sapiens
  misc_feature: HIJSMM301B1I8I.51.43.D10.1.454.light.4.raw
cgatcgtatacacgaccggtgctcgatttagactagcagtaagggcacgaccggtgctcgatttagactagcagtaaggggctgggcctaaggaagcagcactggtggtgcctcagccatggcctggaccgttctcctcctcggcctcctctctcactgcacagtctctgtgacatcctatgtgctgactcagccaccctcggtgtcagtggccccaggacagacggccaggatttcctgtgggggagacaacattggaagtaaagtgtacactggtaccagcagaggccaggccaggcccctgtgttggtcgtctatgattataacgaccggccctcagggatccctgaccgattctctggctccatctctgggaacacggccactctgaccatcagcagggtcgaagccggggatgaggccgactattactgtcaggtgtgggaaagtagtagtgatcattatgtcttcggaagtgggaccaaggtcaccgtcctaggtcagcccaagg

SEQ ID NO: 543678 - DNA, 508 bp, Homo sapiens
  misc_feature: HIJSMM301C9H2R.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccaggacagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggcaaccccactgtcactctgttcccg

SEQ ID NO: 543679 - DNA, 479 bp, Homo sapiens
  misc_feature: HIJSMM301ASND3.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagagtcagacgaactgtggctgcaccatctgtctt

SEQ ID NO: 543680 - DNA, 498 bp, Homo sapiens
  misc_feature: HIJSMM301A0UHB.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaactagtggctgcaccatctgtcttcatcttcccgccat

SEQ ID NO: 543681 - DNA, 477 bp, Homo sapiens
  misc_feature: HIJSMM301CRQ5Z.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgcaa

SEQ ID NO: 543682 - DNA, 498 bp, Homo sapiens
  misc_feature: HIJSMM301A89XG.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggaggaccaagctgaccgtcctaggtcagccaaggctgccccctcggtcactctgttcccgcctcctcgctacgtaga

SEQ ID NO: 543683 - DNA, 521 bp, Homo sapiens
  misc_feature: HIJSMM301DFRL0.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcactctgttcccgccct

SEQ ID NO: 543684 - DNA, 478 bp, Homo sapiens; identical to SEQ ID NO: 535129
  misc_feature: HIJSMM301EEGI4.11.11.A11.1.454.light.4.raw

SEQ ID NO: 543685 - DNA, 484 bp, Homo sapiens; identical to SEQ ID NO: 535211
  misc_feature: HIJSMM301DJTPG.47.46.E02.1.454.light.4.raw

SEQ ID NO: 543686 - DNA, 498 bp, Homo sapiens
  misc_feature: HIJSMM301AWGG2.13.76.G10.1.454.light.4.raw
tcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgacccgtcctcggtcagcccaaggctgcccc

SEQ ID NO: 543687 - DNA, 495 bp, Homo sapiens; identical to SEQ ID NO: 535596
  misc_feature: HIJSMM301CL7CJ.10.79.H02.1.454.light.4.raw

SEQ ID NO: 543688 - DNA, 515 bp, Homo sapiens; identical to SEQ ID NO: 543484
  misc_feature: HIJSMM301CWERE.14.19.B08.1.454.light.4.raw

SEQ ID NO: 543689 - DNA, 494 bp, Homo sapiens; identical to SEQ ID NO: 534992
  misc_feature: HIJSMM301CO6QK.9.1.A01.1.454.light.4.raw

SEQ ID NO: 543690 - DNA, 493 bp, Homo sapiens; identical to SEQ ID NO: 536461
  misc_feature: HIJSMM301B0OY9.10.20.B09.1.454.light.4.raw

SEQ ID NO: 543691 - DNA, 489 bp, Homo sapiens; identical to SEQ ID NO: 535386
  misc_feature: HIJSMM301CMIS1.12.51.E07.1.454.light.4.raw

SEQ ID NO: 543692 - DNA, 519 bp, Homo sapiens
  misc_feature: HIJSMM301CJEE7.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccgccctcct

SEQ ID NO: 543693 - DNA, 484 bp, Homo sapiens; identical to SEQ ID NO: 535400
  misc_feature: HIJSMM301A5N0Q.46.26.C04.1.454.light.4.raw

SEQ ID NO: 543694 - DNA, 494 bp, Homo sapiens; identical to SEQ ID NO: 539784
  misc_feature: HIJSMM301EOWQA.22.57.F02.1.454.light.4.raw

SEQ ID NO: 543695 - DNA, 502 bp, Homo sapiens
  misc_feature: HIJSMM301BSEDO.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccatgtca

SEQ ID NO: 543696 - DNA, 478 bp, Homo sapiens
  misc_feature: HIJSMM301AJPD9.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaagtaggatgtcaaccgaactagtggctgcacca

SEQ ID NO: 543697 - DNA, 447 bp, Homo sapiens
  misc_feature: HIJSMM301AGS1L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtccggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 543698 - DNA, 497 bp, Homo sapiens; identical to SEQ ID NO: 536371
  misc_feature: HIJSMM301D8Y59.16.78.H01.1.454.light.4.raw

SEQ ID NO: 543699 - DNA, 490 bp, Homo sapiens
  misc_feature: HIJSMM301CQQ5Z.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaacgaactgtggctgcaccatct

SEQ ID NO: 543700 - DNA, 444 bp, Homo sapiens
  misc_feature: HIJSMM301CBQTG.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgatttattactgtcagtcctttgacattaaactggatgtggtattcggcggagggacccacgtaaccgtcctaggtcagcccaaggctcgccccctcggtcactctcgttcccaccctcctcgtatctctcg

SEQ ID NO: 543701 - DNA, 479 bp, Homo sapiens
  misc_feature: HIJSMM301CUFGQ.52.77.G11.1.454.light.4.raw
cgcagtacgacacgaccggtgctcgatttagctagtcactcaagggaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcggggggaccaaggtggagatcaaacgaactgtgg

SEQ ID NO: 543702 - DNA, 502 bp, Homo sapiens; identical to SEQ ID NO: 536604
  misc_feature: HIJSMM301CU62J.27.78.H01.1.454.light.4.raw

SEQ ID NO: 543703 - DNA, 494 bp, Homo sapiens; identical to SEQ ID NO: 534994
  misc_feature: HIJSMM301BAGY4.27.78.H01.1.454.light.4.raw

SEQ ID NO: 543704 - DNA, 447 bp, Homo sapiens; identical to SEQ ID NO: 535020
  misc_feature: HIJSMM301DDPBU.18.9.A09.1.454.light.4.raw

SEQ ID NO: 543705 - DNA, 517 bp, Homo sapiens; identical to SEQ ID NO: 541566
  misc_feature: HIJSMM301DJXPJ.22.30.C08.1.454.light.4.raw

SEQ ID NO: 543706 - DNA, 502 bp, Homo sapiens
  misc_feature: HIJSMM301C724W.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtggaaagtacaaacgaactagtggctgcaccatctgtcttcatcttccccg

SEQ ID NO: 543707 - DNA, 505 bp, Homo sapiens
  misc_feature: HIJSMM301C36Q8.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagagtcaaacgaactgtggctgcaccatct

SEQ ID NO: 543708 - DNA, 487 bp, Homo sapiens; identical to SEQ ID NO: 537573
  misc_feature: HIJSMM301CO784.3.10.A10.1.454.light.4.raw

SEQ ID NO: 543709 - DNA, 488 bp, Homo sapiens; identical to SEQ ID NO: 535081
  misc_feature: HIJSMM301AIO37.26.23.C01.1.454.light.4.raw

SEQ ID NO: 543710 - DNA, 491 bp, Homo sapiens; identical to SEQ ID NO: 535294
  misc_feature: HIJSMM301BPVFC.16.68.G02.1.454.light.4.raw

SEQ ID NO: 543711 - DNA, 484 bp, Homo sapiens; identical to SEQ ID NO: 535240
  misc_feature: HIJSMM301BM9IY.47.60.F05.1.454.light.4.raw

SEQ ID NO: 543712 - DNA, 496 bp, Homo sapiens; identical to SEQ ID NO: 535109
  misc_feature: HIJSMM301DYM3A.16.78.H01.1.454.light.4.raw

SEQ ID NO: 543713 - DNA, 454 bp, Homo sapiens; identical to SEQ ID NO: 534964
  misc_feature: HIJSMM301BATUX.19.86.H09.1.454.light.4.raw

SEQ ID NO: 543714 - DNA, 497 bp, Homo sapiens; identical to SEQ ID NO: 535664
  misc_feature: HIJSMM301BC623.22.14.B03.1.454.light.4.raw

SEQ ID NO: 543715 - DNA, 495 bp, Homo sapiens; identical to SEQ ID NO: 538673
  misc_feature: HIJSMM301CS3DX.51.35.D02.1.454.light.4.raw

SEQ ID NO: 543716 - DNA, 513 bp, Homo sapiens
  misc_feature: HIJSMM301AR776.15.76.G10.1.454.light.4.raw
  modified_base (499)..(499): a, c, t, g, unknown or other
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcctcgctacg

SEQ ID NO: 543717 - DNA, 487 bp, Homo sapiens; identical to SEQ ID NO: 535583
  misc_feature: HIJSMM301AJEAQ.22.73.G07.1.454.light.4.raw

SEQ ID NO: 543718 - DNA, 496 bp, Homo sapiens; identical to SEQ ID NO: 541091
  misc_feature: HIJSMM301BWZO9.22.9.A09.1.454.light.4.raw

SEQ ID NO: 543719 - DNA, 485 bp, Homo sapiens
  misc_feature: HIJSMM301ASUL1.47.25.C03.1.454.light.4.raw
agctcacgtacacgaccggtgctcgatttagtagtgtagatttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgccctcctctacgtgagct

SEQ ID NO: 543720 - DNA, 500 bp, Homo sapiens
  misc_feature: HIJSMM301D5SM8.14.55.E11.1.454.light.4.raw
  modified_base (431)..(431): a, c, t, g, unknown or other
  modified_base (499)..(499): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatcccagatgacccagtcgtccatcctcccgtgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcggcagtctgcaacctgaagattttgcaacttactactggtcaacagagttacagtacccccctnacttttcggcggagggaccaaggcggagattcagaccgaacttgtggctgcaccaatctggtcttctnt

SEQ ID NO: 543721 - DNA, 509 bp, Homo sapiens
  misc_feature: HIJSMM301DWZE5.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtgaggctgaggatgttggggtttattactgcatgcaaactacacacggccgctcactttcggcggagggaccgaacggtggaggatcaaacgaaactgtggctgcaccatctgtt

SEQ ID NO: 543722 - DNA, 503 bp, Homo sapiens; identical to SEQ ID NO: 537189
  misc_feature: HIJSMM301CX6ID.19.85.H08.1.454.light.4.raw

SEQ ID NO: 543723 - DNA, 470 bp, Homo sapiens
  misc_feature: HIJSMM301DA8V9.7.81.H04.1.454.light.4.raw
cgtgtctctacacgaccggtgctcgatttagtagtgtagattcgcgggggagtcagtctcagtcaggacacagcatggacatgacgggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctgggactgaagtgcatatgaagagaactgtgg

SEQ ID NO: 543724 - DNA, 495 bp, Homo sapiens
  misc_feature: HIJSMM301EBT1G.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttccccaccctcctcgctacgtaga

SEQ ID NO: 543725 - DNA, 487 bp, Homo sapiens
  misc_feature: HIJSMM301APZGR.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagactggagatcaaacgaactgtggctgcaccat

SEQ ID NO: 543726 - DNA, 519 bp, Homo sapiens
  misc_feature: HIJSMM301DQMMZ.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaagtgaccgtcctaagtcagcccaaggctgccccctcggtcactctgttcccgccct

SEQ ID NO: 543727 - DNA, 484 bp, Homo sapiens; identical to SEQ ID NO: 535441
  misc_feature: HIJSMM301BLWKC.26.60.F05.1.454.light.4.raw

SEQ ID NO: 543728 - DNA, 481 bp, Homo sapiens; identical to SEQ ID NO: 535628
  misc_feature: HIJSMM301DRGPS.14.11.A11.1.454.light.4.raw

SEQ ID NO: 543729 - DNA, 516 bp, Homo sapiens
  misc_feature: HIJSMM301CA2KL.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcct

SEQ ID NO: 543730 - DNA, 493 bp, Homo sapiens
  misc_feature: HIJSMM301AT0DT.48.75.G09.1.454.light.4.raw
agtatacatacacgaccggtgctcgatttagtatagacatcagggcacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggtaccg

SEQ ID NO: 543731 - DNA, 500 bp, Homo sapiens
  misc_feature: HIJSMM301DZI6Y.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtcgtcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagccaaggctgccccctcggtcactctcgttcccaccctcctctgtcgagcgt

SEQ ID NO: 543732 - DNA, 496 bp, Homo sapiens
  misc_feature: HIJSMM301C13TM.41.64.F09.1.454.light.4.raw
  modified_base (470)..(470): a, c, t, g, unknown or other
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccgagtcagagcattggttatagcttacactggtaccagcagaaaccagatcagcctccaaagctcctcatcaagtatgcttcccagtccatctcacggggtcccctcgaggttcagtggcagtggatctgggacagattttcaccctcaccatcaatagcctggaagctgaagatgttgcaacgtattactgtcatcagagtagtactttacctcggcctcgtcgacggacgacgacnggagataacgtaaacagtggcgtgca

SEQ ID NO: 543733 - DNA, 495 bp, Homo sapiens; identical to SEQ ID NO: 535596
  misc_feature: HIJSMM301EC7S3.10.79.H02.1.454.light.4.raw

SEQ ID NO: 543734 - DNA, 502 bp, Homo sapiens
  misc_feature: HIJSMM301BHN43.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaaagtggatatcaaacgaactgtggctgcaccatctgt

SEQ ID NO: 543735 - DNA, 464 bp, Homo sapiens; identical to SEQ ID NO: 539492
  misc_feature: HIJSMM301ASX24.18.59.F04.1.454.light.4.raw

SEQ ID NO: 543736 - DNA, 508 bp, Homo sapiens; identical to SEQ ID NO: 536388
  misc_feature: HIJSMM301DT049.11.57.F02.1.454.light.4.raw

SEQ ID NO: 543737 - DNA, 489 bp, Homo sapiens
  misc_feature: HIJSMM301BA7VR.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcgccaagggacacgactggagattaaacgaactgtggctgcaccatctgtcttcat

SEQ ID NO: 543738 - DNA, 490 bp, Homo sapiens
  misc_feature: HIJSMM301CD5OF.52.27.C05.1.454.light.4.raw
  modified_base (415)..(415): a, c, t, g, unknown or other
cgcagtacgacacgaccggtgctcgatttagacgcgatcgaagggtttgggggtgggggcacttctccctctaacactctcccgctcagctcctgggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtcccgtcaaggttcagtggccgtggatctgggacagatttcactctcaccatcagcagtctccaacctgaagattttgcaatttactactgtcaacagagtgacaatacccctnagactttcggccctgggaccagagtggatatcaaacgaactgtggctgcaccatctgtcttcatcttcccgccat

SEQ ID NO: 543739 - DNA, 511 bp, Homo sapiens
  misc_feature: HIJSMM301BVQ83.5.60.F05.1.454.light.4.raw
atcagacacgcacgaccggtgctcgatttagtacgtcatcagggaaagggggcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaaagctgaccgtcctcggtcagcccaaggctgccccctcggt

SEQ ID NO: 543740 - DNA, 496 bp, Homo sapiens; identical to SEQ ID NO: 540207
  misc_feature: HIJSMM301CBIO4.40.57.F02.1.454.light.4.raw

SEQ ID NO: 543741 - DNA, 509 bp, Homo sapiens
  misc_feature: HIJSMM301BIQR4.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccg

SEQ ID NO: 543742 - DNA, 499 bp, Homo sapiens
  misc_feature: HIJSMM301A8Q4Y.43.57.F02.1.454.light.4.raw
tgtgagtagtcacgaccggtgctcgatttagctcgatatagttgggtttgggggctttgcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccaccctcctcactactcaca

SEQ ID NO: 543743 - DNA, 456 bp, Homo sapiens
  misc_feature: HIJSMM301DLJI9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccggcagacggtcaccatcgcttgttctgcaagcagctcgaacatcgggagcagtggtgtgatgtggtatcagaaagtcccaggaacggcccccaaactcgtcatctataatgacgctgagcggtccttaagggtcccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctccggtcactctgttcccaccctcctccaccgagagta

SEQ ID NO: 543744 - DNA, 478 bp, Homo sapiens
  misc_feature: HIJSMM301BGYCC.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagtatttttgttaaggggaaagtaatgaagttaacactgtggatcaccttcggccaagggacacgactggagattaaacgaactgtggctgcaccatctgtcttcatcttcccgccatctgaagtatagtct

SEQ ID NO: 543745 - DNA, 493 bp, Homo sapiens
  misc_feature: HIJSMM301DD731.10.25.C03.1.454.light.4.raw
catagtagtgcacgaccggtgctcgatttagtagtgtagatttgggtttggggagagctctggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcggagtgggtctgggacagagttcgctctcaccatcagcagtctgcagtctgaagattttgcagtttattactgtcaggaatatgatggctggcctccgtacacttttggccaagggaccaagttggacatcaaacgaactgtgg

SEQ ID NO: 543746 - DNA, 507 bp, Homo sapiens; identical to SEQ ID NO: 541461
  misc_feature: HIJSMM301DELBD.11.57.F02.1.454.light.4.raw

SEQ ID NO: 543747 - DNA, 454 bp, Homo sapiens; identical to SEQ ID NO: 534964
  misc_feature: HIJSMM301CVGSF.19.86.H09.1.454.light.4.raw

SEQ ID NO: 543748 - DNA, 454 bp, Homo sapiens
  misc_feature: HIJSMM301BSEOQ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccaccgagagta

SEQ ID NO: 543749 - DNA, 490 bp, Homo sapiens; identical to SEQ ID NO: 535234
  misc_feature: HIJSMM301ASLAU.17.21.B10.1.454.light.4.raw

SEQ ID NO: 543750 - DNA, 496 bp, Homo sapiens; identical to SEQ ID NO: 535109
  misc_feature: HIJSMM301EZ8LR.16.78.H01.1.454.light.4.raw

SEQ ID NO: 543751 - DNA, 508 bp, Homo sapiens; identical to SEQ ID NO: 535835
  misc_feature: HIJSMM301EDCSK.8.34.D01.1.454.light.4.raw

SEQ ID NO: 543752 - DNA, 484 bp, Homo sapiens; identical to SEQ ID NO: 535400
  misc_feature: HIJSMM301D5LTB.46.26.C04.1.454.light.4.raw

SEQ ID NO: 543753 - DNA, 504 bp, Homo sapiens; identical to SEQ ID NO: 538940
  misc_feature: HIJSMM301CH2L0.2.35.D02.1.454.light.4.raw

SEQ ID NO: 543754 - DNA, 493 bp, Homo sapiens
  misc_feature: HIJSMM301A19Z5.52.83.H06.1.454.light.4.raw
cgcagtacgacacgaccggtgctcgatttagatcacgtgcgtcgcgggggagtcagtcccaaccaggacacagcatggacatgagggtccccgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacatttttactttctaccatcagcggcctgcagcctgaagatattgcaacatattactgtcaacagtatggtaatctcccactcactttcggcggagggaccaaggtcgagatcaaacgaactagtggctgcaccatctgtcttcta

SEQ ID NO: 543755 - DNA, 491 bp, Homo sapiens; identical to SEQ ID NO: 536693
  misc_feature: HIJSMM301AFWRS.19.83.H06.1.454.light.4.raw

SEQ ID NO: 543756 - DNA, 512 bp, Homo sapiens
  misc_feature: HIJSMM301BOACE.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcgcggagggaccaagctgaccgtcctaggtcagcccaaggctgccccctcggtcactctgttcccg

SEQ ID NO: 543757 - DNA, 493 bp, Homo sapiens; identical to SEQ ID NO: 535614
  misc_feature: HIJSMM301B900C.9.1.A01.1.454.light.4.raw

SEQ ID NO: 543758 - DNA, 488 bp, Homo sapiens
  misc_feature: HIJSMM301CTUTT.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggtcggagggaccgaaaggtggaggatcaaacgaaa

SEQ ID NO: 543759 - DNA, 493 bp, Homo sapiens; identical to SEQ ID NO: 535047
  misc_feature: HIJSMM301B6GU7.16.53.E09.1.454.light.4.raw

SEQ ID NO: 543760 - DNA, 489 bp, Homo sapiens; identical to SEQ ID NO: 539323
  misc_feature: HIJSMM301DIHKU.49.46.E02.1.454.light.4.raw

SEQ ID NO: 543761 - DNA, 511 bp, Homo sapiens
  misc_feature: HIJSMM301BN7OX.14.70.G04.1.454.light.4.raw
  modified_base (505)..(505): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccacngtcact

SEQ ID NO: 543762 - DNA, 497 bp, Homo sapiens; identical to SEQ ID NO: 535886
  misc_feature: HIJSMM301D8FC9.8.10.A10.1.454.light.4.raw

SEQ ID NO: 543763 - DNA, 463 bp, Homo sapiens; identical to SEQ ID NO: 535062
  misc_feature: HIJSMM301E2SYE.11.73.G07.1.454.light.4.raw

SEQ ID NO: 543764 - DNA, 487 bp, Homo sapiens; identical to SEQ ID NO: 540841
  misc_feature: HIJSMM301EL74M.4.33.C11.1.454.light.4.raw

SEQ ID NO: 543765 - DNA, 497 bp, Homo sapiens
  misc_feature: HIJSMM301BV00V.51.80.H03.1.454.light.4.raw
cgatcgtatacacgaccggtgctcgatttagctgtgcgtcgaagggaaagggctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcggagggaccaagctgaccgtcctaggtcagcccaaggctgccccctcggtcactctgttcccg

SEQ ID NO: 543766 - DNA, 491 bp, Homo sapiens
  misc_feature: HIJSMM301C4GT1.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttc

SEQ ID NO: 543767 - DNA, 507 bp, Homo sapiens
  misc_feature: HIJSMM301B0AL6.21.87.H10.1.454.light.4.raw
tcgtcgctcgcacgaccggtgctcgatttagcagtactgcgttgggtttgggggggtcgacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggt

SEQ ID NO: 543768 - DNA, 503 bp, Homo sapiens; identical to SEQ ID NO: 539976
  misc_feature: HIJSMM301B3DM0.47.55.E11.1.454.light.4.raw

SEQ ID NO: 543769 - DNA, 513 bp, Homo sapiens; identical to SEQ ID NO: 535719
  misc_feature: HIJSMM301CIO77.17.33.C11.1.454.light.4.raw

SEQ ID NO: 543770 - DNA, 484 bp, Homo sapiens; identical to SEQ ID NO: 535400
  misc_feature: HIJSMM301D9W0W.46.26.C04.1.454.light.4.raw

SEQ ID NO: 543771 - DNA, 494 bp, Homo sapiens
  misc_feature: HIJSMM301ADBSP.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaaccaagctgagatcaaacgaactgtggc

SEQ ID NO: 543772 - DNA, 509 bp, Homo sapiens
  misc_feature: HIJSMM301BIM2F.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 543773 - DNA, 486 bp, Homo sapiens
  misc_feature: HIJSMM301A0R3C.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaacgaactagtggctgca

SEQ ID NO: 543774 - DNA, 493 bp, Homo sapiens
  misc_feature: HIJSMM301BETR7.5.40.D07.1.454.light.4.raw
atcagacacgcacgaccggtgctcgatttagtgatagagcgtaacaacagaggggggaacgtgctcagttaggacccacgacggaaccaatggaagccccacgcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtgggacgaaccaaacgtaactggtggctcgccaacc

SEQ ID NO: 543775 - DNA, 476 bp, Homo sapiens
  misc_feature: HIJSMM301C6ZQ8.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtgggtcccatcaaggttcagtggcagtggatctgggacagatttcactctcaccatccgcagtctgcaacctgaagattttgcaatttattactgtcaagagactcacaatggaggcacttttggccaggggaccaagctggagaggaaacgaactgtggctgcaccat

SEQ ID NO: 543776 - DNA, 485 bp, Homo sapiens; identical to SEQ ID NO: 536576
  misc_feature: HIJSMM301EL8WG.46.35.D02.1.454.light.4.raw

SEQ ID NO: 543777 - DNA, 447 bp, Homo sapiens; identical to SEQ ID NO: 535882
  misc_feature: HIJSMM301COPP4.18.9.A09.1.454.light.4.raw
  modified_base (429)..(429): a, c, t, g, unknown or other

SEQ ID NO: 543778 - DNA, 512 bp, Homo sapiens
  misc_feature: HIJSMM301D19IC.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctccggtcactctgttccgccctcctca

SEQ ID NO: 543779 - DNA, 484 bp, Homo sapiens; identical to SEQ ID NO: 535240
  misc_feature: HIJSMM301DFYKK.47.60.F05.1.454.light.4.raw

SEQ ID NO: 543780 - DNA, 513 bp, Homo sapiens
  misc_feature: HIJSMM301DCBIK.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccaccctcct

SEQ ID NO: 543781 - DNA, 499 bp, Homo sapiens
  misc_feature: HIJSMM301B1MZF.13.55.E11.1.454.light.4.raw
tcacgtactacacgaccggtgctcgatttagcactcgcacgttgggtttggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaaggaccaaggtggaaatacaaacgaactgtggctgcaccatctgtcttctatcttccccg

SEQ ID NO: 543782 - DNA, 501 bp, Homo sapiens
  misc_feature: HIJSMM301EEWBE.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccaaagtggagatcaaacgaactgtggctgcacca

SEQ ID NO: 543783 - DNA, 494 bp, Homo sapiens; identical to SEQ ID NO: 534992
  misc_feature: HIJSMM301A534M.9.1.A01.1.454.light.4.raw

SEQ ID NO: 543784 - DNA, 445 bp, Homo sapiens
  misc_feature: HIJSMM301DB9JG.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgttttgggtgttcggcggagggaccaagctgaccgtcctaagtcagcccaaggctgccccctcggtcactctgttcccaccctcctccgtgtctgat

SEQ ID NO: 543785 - DNA, 440 bp, Homo sapiens
  misc_feature: HIJSMM301BIT9C.4.22.B11.1.454.light.4.raw
agcactgtagcacgaccggtgctcgatttagacgacagctcaggggtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaaacgaactgtggctgcaccatctgtcttcatcttcccgccatctgactacagtgct

SEQ ID NO: 543786 - DNA, 384 bp, Homo sapiens
  misc_feature: HIJSMM301AROIP.41.26.C04.1.454.light.4.raw
tctatactatcacgaccggtgctcgatttagtctagcgactttgggtttggggaaaggagccaccctactcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 543787 - DNA, 496 bp, Homo sapiens; identical to SEQ ID NO: 540257
  misc_feature: HIJSMM301AJDU6.41.6.A06.1.454.light.4.raw

SEQ ID NO: 543788 - DNA, 488 bp, Homo sapiens; identical to SEQ ID NO: 537260
  misc_feature: HIJSMM301BLK7H.47.70.G04.1.454.light.4.raw

SEQ ID NO: 543789 - DNA, 494 bp, Homo sapiens; identical to SEQ ID NO: 535478
  misc_feature: HIJSMM301A9PPP.10.79.H02.1.454.light.4.raw

SEQ ID NO: 543790 - DNA, 512 bp, Homo sapiens; identical to SEQ ID NO: 542831
  misc_feature: HIJSMM301B6FR5.43.19.B08.1.454.light.4.raw

SEQ ID NO: 543791 - DNA, 504 bp, Homo sapiens; identical to SEQ ID NO: 538940
  misc_feature: HIJSMM301A4T74.2.35.D02.1.454.light.4.raw

SEQ ID NO: 543792 - DNA, 503 bp, Homo sapiens; identical to SEQ ID NO: 535044
  misc_feature: HIJSMM301AYOJ1.19.78.H01.1.454.light.4.raw

SEQ ID NO: 543793 - DNA, 491 bp, Homo sapiens
  misc_feature: HIJSMM301DFC4P.43.20.B09.1.454.light.4.raw
tgtgagtagtcacgaccggtgctcgatttagtgtagtgtgaaggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggccaagggaccaaggtggaaatcaaacgaactgtggctgcaccatctgtcttcta

SEQ ID NO: 543794 - DNA, 509 bp, Homo sapiens
  misc_feature: HIJSMM301BJ3Z3.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggtcgggggacggaacgtaggtagatacaaacgaaacgtagtggtcgtgtcgaccactcttcgttc

SEQ ID NO: 543795 - DNA, 490 bp, Homo sapiens
  misc_feature: HIJSMM301C09UK.43.76.G10.1.454.light.4.raw
tgtgagtagtcacgaccggtgctcgatttagtcactcatacaggggagcttcagctgtggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaa

SEQ ID NO: 543796 - DNA, 506 bp, Homo sapiens
  misc_feature: HIJSMM301CZU2Y.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggccaacccactgtcact

SEQ ID NO: 543797 - DNA, 518 bp, Homo sapiens
  misc_feature: HIJSMM301AXTWT.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccaccctcctccacg

SEQ ID NO: 543798 - DNA, 476 bp, Homo sapiens
  misc_feature: HIJSMM301DH56U.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctctatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaacggtaggaggatcaaacgaa

SEQ ID NO: 543799 - DNA, 514 bp, Homo sapiens
  misc_feature: HIJSMM301C5NDP.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccccg

SEQ ID NO: 543800 - DNA, 447 bp, Homo sapiens; identical to SEQ ID NO: 535201
  misc_feature: HIJSMM301AONI8.18.9.A09.1.454.light.4.raw

SEQ ID NO: 543801 - DNA, 497 bp, Homo sapiens
  misc_feature: HIJSMM301AJEKS.43.71.G05.1.454.light.4.raw
tgtgagtagtcacgaccggtgctcgatttagtgtcgtcgcaagagagagggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 543802 - DNA, 505 bp, Homo sapiens; identical to SEQ ID NO: 536117
  misc_feature: HIJSMM301ASHME.8.71.G05.1.454.light.4.raw

SEQ ID NO: 543803 - DNA, 478 bp, Homo sapiens
  misc_feature: HIJSMM301APCY9.11.11.A11.1.454.light.4.raw
cgagagataccacgaccggtgctcgatttagctacgactgcaggggcagcaatatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 543804 - DNA, 484 bp, Homo sapiens; identical to SEQ ID NO: 542211
  misc_feature: HIJSMM301CM0T5.13.36.D03.1.454.light.4.raw

SEQ ID NO: 543805 - DNA, 503 bp, Homo sapiens; identical to SEQ ID NO: 535044
  misc_feature: HIJSMM301A1UD9.19.78.H01.1.454.light.4.raw

SEQ ID NO: 543806 - DNA, 489 bp, Homo sapiens
  misc_feature: HIJSMM301BH73D.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggtattttgctaacttattactgccagcagtataatgattaccctatccaccttcggccggggacacggctaggaaactaaacgaactgtggctgcacca

SEQ ID NO: 543807 - DNA, 446 bp, Homo sapiens
  misc_feature: HIJSMM301BQBNO.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttggggtgtttggggtgttcggcggagggaccaagctgaccgtcctaagtcagcccaaggctgccccctcggtcactctgttcccgccctcctccgtgtctgat

SEQ ID NO: 543808 - DNA, 494 bp, Homo sapiens; identical to SEQ ID NO: 534992
  misc_feature: HIJSMM301AYKE0.9.1.A01.1.454.light.4.raw

SEQ ID NO: 543809 - DNA, 489 bp, Homo sapiens
  misc_feature: HIJSMM301A1MYF.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 543810 - DNA, 494 bp, Homo sapiens; identical to SEQ ID NO: 534994
  misc_feature: HIJSMM301DAERU.27.78.H01.1.454.light.4.raw

SEQ ID NO: 543811 - DNA, 488 bp, Homo sapiens
  misc_feature: HIJSMM301D8M1B.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctggcggcggtccaggctacgtcatactttggatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccatct

SEQ ID NO: 543812 - DNA, 508 bp, Homo sapiens
  misc_feature: HIJSMM301B8HS5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggccaaggaccgaacggtggaaggtcaaacgaactagtggctgcaccactctgtcttcatcttcccgcccat

SEQ ID NO: 543813 - DNA, 513 bp, Homo sapiens
  misc_feature: HIJSMM301CYGON.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccgccctt

SEQ ID NO: 543814 - DNA, 497 bp, Homo sapiens
  misc_feature: HIJSMM301BO2OL.49.30.C08.1.454.light.4.raw
agtcgagagacacgaccggtgctcgatttagtctgacgtcaaagggaaagggggagggaactgctcagttaggacccacgagggaaccgatggaagccccacgctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 543815 - DNA, 460 bp, Homo sapiens; identical to SEQ ID NO: 536053
  misc_feature: HIJSMM301CMOM6.22.28.C06.1.454.light.4.raw

SEQ ID NO: 543816 - DNA, 503 bp, Homo sapiens
  misc_feature: HIJSMM301BX50V.5.86.H09.1.454.light.4.raw
atcagacacgcacgaccggtgctcgatttagtgctatagacttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 543817 - DNA, 488 bp, Homo sapiens
  misc_feature: HIJSMM301CZT4U.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccattctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaacgaactgtggctgcaccatctgtcttcat

SEQ ID NO: 543818 - DNA, 481 bp, Homo sapiens
  misc_feature: HIJSMM301CB1B6.49.83.H06.1.454.light.4.raw
agtcgagagacacgaccggtgctcgatttagatcacgtgcgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccactttcgccctggaccaggctagatatcggacgaactgtggctgcaccat

SEQ ID NO: 543819 - DNA, 491 bp, Homo sapiens; identical to SEQ ID NO: 536988
  misc_feature: HIJSMM301CRBLP.17.21.B10.1.454.light.4.raw

SEQ ID NO: 543820 - DNA, 497 bp, Homo sapiens
  misc_feature: HIJSMM301DNGDA.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctgaccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccat

SEQ ID NO: 543821 - DNA, 495 bp, Homo sapiens; identical to SEQ ID NO: 535821
  misc_feature: HIJSMM301C4PJ1.3.31.C09.1.454.light.4.raw

SEQ ID NO: 543822 - DNA, 494 bp, Homo sapiens; identical to SEQ ID NO: 534992
  misc_feature: HIJSMM301CPE04.9.1.A01.1.454.light.4.raw

SEQ ID NO: 543823 - DNA, 494 bp, Homo sapiens; identical to SEQ ID NO: 535276
  misc_feature: HIJSMM301CEQBY.16.6.A06.1.454.light.4.raw

SEQ ID NO: 543824 - DNA, 444 bp, Homo sapiens; identical to SEQ ID NO: 540477
  misc_feature: HIJSMM301A4CDE.17.21.B10.1.454.light.4.raw

SEQ ID NO: 543825 - DNA, 442 bp, Homo sapiens; identical to SEQ ID NO: 535927
  misc_feature: HIJSMM301COVPN.8.73.G07.1.454.light.4.raw

SEQ ID NO: 543826 - DNA, 480 bp, Homo sapiens
  misc_feature: HIJSMM301BY13R.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgccagggacgagactgagatcaacgaactagtggctgcaccact

SEQ ID NO: 543827 - DNA, 486 bp, Homo sapiens; identical to SEQ ID NO: 535385
  misc_feature: HIJSMM301C0NS8.19.71.G05.1.454.light.4.raw

SEQ ID NO: 543828 - DNA, 480 bp, Homo sapiens
  misc_feature: HIJSMM301EVSJD.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggttgtgtcttttcggcggagggaccaagctgacgtcctacgtcagcccaaggctgccccctc

SEQ ID NO: 543829 - DNA, 458 bp, Homo sapiens
  misc_feature: HIJSMM301BV97Z.51.47.E03.1.454.light.4.raw
cgatcgtatacacgaccggtgctcgatttagactcgcgcacagagagaaggggggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 543830 - DNA, 472 bp, Homo sapiens
  misc_feature: HIJSMM301CMQQ1.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccactttgtgggggacggaacgtaggacgatacaacgaa

SEQ ID NO: 543831 - DNA, 322 bp, Homo sapiens
  misc_feature: HIJSMM301EPIRC.49.44.D11.1.454.light.4.raw
agtcgagagacacgaccggtgctcgatttagcgcagtacgaagggacagggaccagagccagtccagggagaggacagagccaatggactggggtgtactgtaacagccctgctggtcccaggcagtgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccaccctcctctctctcgact

SEQ ID NO: 543832 - DNA, 506 bp, Homo sapiens
  misc_feature: HIJSMM301CT1X2.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgc

SEQ ID NO: 543833 - DNA, 501 bp, Homo sapiens
  misc_feature: HIJSMM301BGK5X.11.75.G09.1.454.light.4.raw
cgagagataccacgaccggtgctcgatttagtatagacatcaggggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctcgaccggttctctggctccaagtctggctcttccgcctccttggccatcactgggctcgaggctgacgatgaggctgattactactgtctgtcctatgacgacgacctacagactccgggttttcggcggagggactaagctgaccgtcctaagtcagcccaa

SEQ ID NO: 543834 - DNA, 517 bp, Homo sapiens
  misc_feature: HIJSMM301DCWZT.18.26.C04.1.454.light.4.raw
tacgagtatgcacgaccggtgctcgatttagtctagcgactttgggtttggggggtcgagacccagtcgggacacagcatggacatgagggtccccgctcagctcctggggctcctgctgctctggttcccaggttccagatgcgacatccagatgacccagtctccatcttccgtggctgccttctgtaggagacagagtcagcatcacttgtcggacgagtcaacatattagctgggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaactaggctgacaggttcccgctgactttcggcggagggaccgaacgggtagaggaatacgaaaggaaactgtggactgcaccatctgtccttcactcttcccgtcccta

SEQ ID NO: 543835 - DNA, 493 bp, Homo sapiens; identical to SEQ ID NO: 540127
  misc_feature: HIJSMM301B1S5Q.10.17.B06.1.454.light.4.raw

SEQ ID NO: 543836 - DNA, 512 bp, Homo sapiens
  misc_feature: HIJSMM301CJYIB.49.82.H05.1.454.light.4.raw
agtcgagagacacgaccggtgctcgatttagtcgagctctctcgcgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatggttgggaattataaccttttctcctggtaccaacaacacccaggacaaacgcccccaaactcatctatttatgaggccgatcagcggccctcaggggtctctgatcgcttctctggctccacgtctggcagcacggcctccctgacaatctctgggctccaggcgtggggacgaggctgattattattgctgttcatatgccggtgatagtggccgaagggtgttcgggcgggagggaccaaggtgaccgtccgtaggtcacgcccaaggctcgccccctcggt

SEQ ID NO: 543837 - DNA, 502 bp, Homo sapiens
  misc_feature: HIJSMM301CCKVM.40.33.C11.1.454.light.4.raw
tctagcgactcacgaccggtgctcgatttagagtgagctcgttgggtttgggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcctaggtcagcccaaggctgccccctc

SEQ ID NO: 543838 - DNA, 486 bp, Homo sapiens
  misc_feature: HIJSMM301A4KEE.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccaacggtaggaaagtacaaacgaactagtggctgcacca

SEQ ID NO: 543839 - DNA, 486 bp, Homo sapiens; identical to SEQ ID NO: 537238
  misc_feature: HIJSMM301DXGH6.19.71.G05.1.454.light.4.raw

SEQ ID NO: 543840 - DNA, 489 bp, Homo sapiens
  misc_feature: HIJSMM301AQUFP.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaacg

SEQ ID NO: 543841 - DNA, 509 bp, Homo sapiens
  misc_feature: HIJSMM301AUT26.48.5.A05.1.454.light.4.raw
agtatacatacacgaccggtgctcgatttagatagatagacagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgatgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaaagcagccgatccagcctgcggagcctgtggggcaggtcagcccaaggccaaccccactgtcactctcg

SEQ ID NO: 543842 - DNA, 497 bp, Homo sapiens; identical to SEQ ID NO: 536371
  misc_feature: HIJSMM301BZR2H.16.78.H01.1.454.light.4.raw

SEQ ID NO: 543843 - DNA, 481 bp, Homo sapiens; identical to SEQ ID NO: 535993
  misc_feature: HIJSMM301BXSCM.21.25.C03.1.454.light.4.raw

SEQ ID NO: 543844 - DNA, 496 bp, Homo sapiens; identical to SEQ ID NO: 535423
  misc_feature: HIJSMM301AIPA6.3.33.C11.1.454.light.4.raw

SEQ ID NO: 543845 - DNA, 490 bp, Homo sapiens; identical to SEQ ID NO: 535234
  misc_feature: HIJSMM301DAUAU.17.21.B10.1.454.light.4.raw

SEQ ID NO: 543846 - DNA, 520 bp, Homo sapiens
  misc_feature: HIJSMM301ALSLO.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgactcacctaccggtccgaacggaacgaccgactacggtaggaattaaacgtaaaccgtagtggcgtcgcgacccactacttcgtcgtttctactt

SEQ ID NO: 543847 - DNA, 506 bp, Homo sapiens
  misc_feature: HIJSMM301C8QGK.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggt

SEQ ID NO: 543848 - DNA, 496 bp, Homo sapiens
  misc_feature: HIJSMM301AX8JY.7.75.G09.1.454.light.4.raw
cgtgtctctacacgaccggtgctcgatttagtatagacatcagggggcgaggagtcagacccacgtcaggacacagcatggacatgagggtccccggcctcagctcctggggcgtcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacccttcggccacggggacgacgacctggaggaattaaacgaaactgtggctgcaccatctgt

SEQ ID NO: 543849 - DNA, 494 bp, Homo sapiens; identical to SEQ ID NO: 534992
  misc_feature: HIJSMM301AFFMZ.9.1.A01.1.454.light.4.raw

SEQ ID NO: 543850 - DNA, 506 bp, Homo sapiens
  misc_feature: HIJSMM301B1T8F.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaaggaccaaggtggaagtcaagcgaactgtggctgcaccatctgtcttcatcttcccgcc

SEQ ID NO: 543851 - DNA, 504 bp, Homo sapiens; identical to SEQ ID NO: 542968
  misc_feature: HIJSMM301BUD5Z.11.57.F02.1.454.light.4.raw

SEQ ID NO: 543852 - DNA, 482 bp, Homo sapiens; identical to SEQ ID NO: 538815
  misc_feature: HIJSMM301D7W1Y.4.34.D01.1.454.light.4.raw

SEQ ID NO: 543853 - DNA, 472 bp, Homo sapiens; identical to SEQ ID NO: 536302
  misc_feature: HIJSMM301AO3KM.18.76.G10.1.454.light.4.raw

SEQ ID NO: 543854 - DNA, 488 bp, Homo sapiens
  misc_feature: HIJSMM301DDCFN.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttacttcaccatcagcagcctgcagcctgaagatattgcaacatattactgtcaacagtatcataatctccccacttcgccctcggacaaacgtaggagtatcaaacgaaactagtggctgcaccactctgtt

SEQ ID NO: 543855 - DNA, 488 bp, Homo sapiens
  misc_feature: HIJSMM301BW3OI.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggtccaagggaccaaggtggatatcagacgaa

SEQ ID NO: 543856 - DNA, 503 bp, Homo sapiens
  misc_feature: HIJSMM301CHNO9.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccgaaggtggaggatcaaacgaaactgtggctgcaccatctgtcttctatcttccccg

SEQ ID NO: 543857 - DNA, 509 bp, Homo sapiens; identical to SEQ ID NO: 536047
  misc_feature: HIJSMM301AWEEL.17.33.C11.1.454.light.4.raw

SEQ ID NO: 543858 - DNA, 513 bp, Homo sapiens
  misc_feature: HIJSMM301B5MP6.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccgcct

SEQ ID NO: 543859 - DNA, 504 bp, Homo sapiens
  misc_feature: HIJSMM301AZFF1.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagtattttgtagtttattactgtcagcagtatagcagctggcctccactttcggcggaggaccgaaggtggagatccaacgaactgtggctgcaccatctgtcttcatcttccccg

SEQ ID NO: 543860 - DNA, 500 bp, Homo sapiens
  misc_feature: HIJSMM301AKB6G.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcgggggaccgaagcgtgaccgtcctaggtcagcccaaggctgccccctccggtca

SEQ ID NO: 543861 - DNA, 354 bp, Homo sapiens; identical to SEQ ID NO: 535026
  misc_feature: HIJSMM301AJVWW.19.22.B11.1.454.light.4.raw

SEQ ID NO: 543862 - DNA, 492 bp, Homo sapiens
  misc_feature: HIJSMM301B9LZT.43.61.F06.1.454.light.4.raw
tgtgagtagtcacgaccggtgctcgatttagctacgctctaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtattctgtcaacaatatggtagctcaccgtacacttttggccaggggaccaagctagaaatcaaacgaactgtggctgcaccatctgtctt

SEQ ID NO: 543863 - DNA, 500 bp, Homo sapiens
  misc_feature: HIJSMM301ESWVP.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttatttttgtcagcaatattatcatactccgctcactttcggcggagggaccaaggtggagatcaaacgaactgtggctgcacca

SEQ ID NO: 543864 - DNA, 502 bp, Homo sapiens; identical to SEQ ID NO: 543597
  misc_feature: HIJSMM301A6R2T.15.25.C03.1.454.light.4.raw

SEQ ID NO: 543865 - DNA, 486 bp, Homo sapiens
  misc_feature: HIJSMM301BCGM9.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccaaggggccgagggtggaaatcaaacgaactgtggctgcaccta

SEQ ID NO: 543866 - DNA, 490 bp, Homo sapiens; identical to SEQ ID NO: 535488
  misc_feature: HIJSMM301COIA0.41.72.G06.1.454.light.4.raw

SEQ ID NO: 543867 - DNA, 514 bp, Homo sapiens
  misc_feature: HIJSMM301DD2XN.17.33.C11.1.454.light.4.raw
cgtagactagcacgaccggtgctcgatttagagtgagctcgttgggtttgggggcgccaggggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 543868 - DNA, 502 bp, Homo sapiens
  misc_feature: HIJSMM301BAXKA.2.76.G10.1.454.light.4.raw
  modified_base (461)..(461): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggaccaaggtcaccgtccttggt

SEQ ID NO: 543869 - DNA, 422 bp, Homo sapiens; identical to SEQ ID NO: 539580
  misc_feature: HIJSMM301A9YMV.41.12.B01.1.454.light.4.raw

SEQ ID NO: 543870 - DNA, 514 bp, Homo sapiens
  misc_feature: HIJSMM301BMBV3.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctgttcccg

SEQ ID NO: 543871 - DNA, 442 bp, Homo sapiens; identical to SEQ ID NO: 536720
  misc_feature: HIJSMM301AJ94V.11.3.A03.1.454.light.4.raw

SEQ ID NO: 543872 - DNA, 505 bp, Homo sapiens; identical to SEQ ID NO: 535987
  misc_feature: HIJSMM301E1LCW.18.37.D04.1.454.light.4.raw

SEQ ID NO: 543873 - DNA, 486 bp, Homo sapiens
  misc_feature: HIJSMM301BANAS.21.4.A04.1.454.light.4.raw
tcgtcgctcgcacgaccggtgctcgatttagagtagtgatcaggggagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcgaccaagggaccaaggtagaaatgaaacgaactgtggctgcaccat

SEQ ID NO: 543874 - DNA, 505 bp, Homo sapiens
  misc_feature: HIJSMM301BTFEE.10.71.G05.1.454.light.4.raw
  modified_base (489)..(489): a, c, t, g, unknown or other
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaataagaggtcaaacgaactagtggctgnaccatctgtcttctat

SEQ ID NO: 543875 - DNA, 484 bp, Homo sapiens; identical to SEQ ID NO: 535400
  misc_feature: HIJSMM301CI9CE.46.26.C04.1.454.light.4.raw

SEQ ID NO: 543876 - DNA, 495 bp, Homo sapiens
  misc_feature: HIJSMM301BJ4E2.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 543877 - DNA, 494 bp, Homo sapiens; identical to SEQ ID NO: 534992
  misc_feature: HIJSMM301EZ3KX.9.1.A01.1.454.light.4.raw

SEQ ID NO: 543878 - DNA, 484 bp, Homo sapiens; identical to SEQ ID NO: 535211
  misc_feature: HIJSMM301AFJ7I.47.46.E02.1.454.light.4.raw

SEQ ID NO: 543879 - DNA, 487 bp, Homo sapiens; identical to SEQ ID NO: 535069
  misc_feature: HIJSMM301EJ0PH.26.23.C01.1.454.light.4.raw

SEQ ID NO: 543880 - DNA, 477 bp, Homo sapiens
  misc_feature: HIJSMM301C1IAA.4.76.G10.1.454.light.4.raw
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattattggacgttcggccaaggaccgaaggtaggaaatacaaacgaactagtggctgcacat

SEQ ID NO: 543881 - DNA, 493 bp, Homo sapiens; identical to SEQ ID NO: 536471
  misc_feature: HIJSMM301C6EBE.3.71.G05.1.454.light.4.raw

SEQ ID NO: 543882 - DNA, 497 bp, Homo sapiens
  misc_feature: HIJSMM301DRSOU.10.65.F10.1.454.light.4.raw
catagtagtgcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttcccgccta

SEQ ID NO: 543883 - DNA, 509 bp, Homo sapiens; identical to SEQ ID NO: 541168
  misc_feature: HIJSMM301AKUDQ.5.60.F05.1.454.light.4.raw

SEQ ID NO: 543884 - DNA, 490 bp, Homo sapiens
  misc_feature: HIJSMM301A7XPX.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagattttaccctagaaatcagtagagtggaggctgaggatgttggcgactattactgcctgcaagctcggcaattcccgatcaccttcggccccgggacacgactggacattaaacgaactgtgg

SEQ ID NO: 543885 - DNA, 486 bp, Homo sapiens
  misc_feature: HIJSMM301ELRBX.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccagggaccaaagttgagatcaaacgaactgtggctgcaccatctgtt

SEQ ID NO: 543886 - DNA, 461 bp, Homo sapiens
  misc_feature: HIJSMM301CVXIY.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctcgccccctcggtcactctgttcccaccctcctcacgcgtatgt

SEQ ID NO: 543887 - DNA, 499 bp, Homo sapiens
  misc_feature: HIJSMM301D46ZF.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcaccatctgtcttcatcttccccg

SEQ ID NO: 543888 - DNA, 521 bp, Homo sapiens
  misc_feature: HIJSMM301A76YX.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccgccctcctccgtcg

SEQ ID NO: 543889 - DNA, 502 bp, Homo sapiens; identical to SEQ ID NO: 536253
  misc_feature: HIJSMM301BJ5XS.21.22.B11.1.454.light.4.raw

SEQ ID NO: 543890 - DNA, 501 bp, Homo sapiens; identical to SEQ ID NO: 536142
  misc_feature: HIJSMM301C90O6.15.1.A01.1.454.light.4.raw

SEQ ID NO: 543891 - DNA, 417 bp, Homo sapiens
  misc_feature: HIJSMM301DRGJ4.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttccccaccctcctccatactcgta

SEQ ID NO: 543892 - DNA, 507 bp, Homo sapiens; identical to SEQ ID NO: 538702
  misc_feature: HIJSMM301CO4O6.11.57.F02.1.454.light.4.raw

SEQ ID NO: 543893 - DNA, 507 bp, Homo sapiens
  misc_feature: HIJSMM301C5LUS.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggaggatcaagcgaactgtggctgcaccatctgtcttcatcttcccgcc

SEQ ID NO: 543894 - DNA, 496 bp, Homo sapiens
  misc_feature: HIJSMM301AWME5.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttggttcctccatgcaaggtacacactggccttttggtccaggggaccgaacctggagatcaaatgaactgtggctgcaccatctgtctt

SEQ ID NO: 543895 - DNA, 492 bp, Homo sapiens
  misc_feature: HIJSMM301A9FF7.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacctttcggtcggagggaccgaacggtaggagatcaaacgaaa

SEQ ID NO: 543896 - DNA, 501 bp, Homo sapiens
  misc_feature: HIJSMM301C1AIG.48.87.H10.1.454.light.4.raw
agtatacatacacgaccggtgctcgatttagcagtactgcgttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 543897 - DNA, 496 bp, Homo sapiens; identical to SEQ ID NO: 537225
  misc_feature: HIJSMM301BUBKM.11.59.F04.1.454.light.4.raw

SEQ ID NO: 543898 - DNA, 500 bp, Homo sapiens
  misc_feature: HIJSMM301A33Q2.3.35.D02.1.454.light.4.raw
agacgcactccacgaccggtgctcgatttagcacacgatagttgggtttgggggatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcacgtgggtcaggcactgatttcacactgagaattagcagggtggaggctgaggatggttgggtatttatttctgcatgcaagctacacactggccgtactacttttggccaggggaccaagctggagatcaaacgaactgtggctgcacc

SEQ ID NO: 543899 - DNA, 515 bp, Homo sapiens
  misc_feature: HIJSMM301BH3P9.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcggcctgaggacgaggctgagtattactgcctgctctattatggtgggccttgggtgttcggcggagggaccaagctgaccgtcctaggtcagcccaaggctgccccctcggtcactctgttcccaccctcctcgacacgcg

SEQ ID NO: 543900 - DNA, 484 bp, Homo sapiens; identical to SEQ ID NO: 535400
  misc_feature: HIJSMM301CKHSM.46.26.C04.1.454.light.4.raw

SEQ ID NO: 543901 - DNA, 493 bp, Homo sapiens
  misc_feature: HIJSMM301B5SC1.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgtccccccg

SEQ ID NO: 543902 - DNA, 486 bp, Homo sapiens; identical to SEQ ID NO: 540090
  misc_feature: HIJSMM301BOY80.17.36.D03.1.454.light.4.raw

SEQ ID NO: 543903 - DNA, 514 bp, Homo sapiens
  misc_feature: HIJSMM301BI0C7.43.59.F04.1.454.light.4.raw
tgtgagtagtcacgaccggtgctcgatttagtacacacacttagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccct

SEQ ID NO: 543904 - DNA, 502 bp, Homo sapiens; identical to SEQ ID NO: 536253
  misc_feature: HIJSMM301BO549.21.22.B11.1.454.light.4.raw

SEQ ID NO: 543905 - DNA, 488 bp, Homo sapiens
  misc_feature: HIJSMM301CGOQY.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggcgtgaggatgttggcatttattactgcatgcaggctatacaccttcctgccacttttggtcgagggaccaagctggagatcaggcgaacg

SEQ ID NO: 543906 - DNA, 505 bp, Homo sapiens
  misc_feature: HIJSMM301AJYE0.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgtggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcagcagcctagagcctgaagattttgcactttattactgtcagcagcgtagtaactggcctttcactttcggccctgggaccaaagtggatatcaaacgaactgtggctgcaccatctgtcttcatcttcccgcc

SEQ ID NO: 543907 - DNA, 511 bp, Homo sapiens
  misc_feature: HIJSMM301BWV7P.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgtcccgccctcctca

SEQ ID NO: 543908 - DNA, 486 bp, Homo sapiens; identical to SEQ ID NO: 536323
  misc_feature: HIJSMM301EYDYX.10.2.A02.1.454.light.4.raw

SEQ ID NO: 543909 - DNA, 490 bp, Homo sapiens
  misc_feature: HIJSMM301B8J9I.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcaccatctgtcttcta

SEQ ID NO: 543910 - DNA, 484 bp, Homo sapiens; identical to SEQ ID NO: 536162
  misc_feature: HIJSMM301DCO7G.13.59.F04.1.454.light.4.raw

SEQ ID NO: 543911 - DNA, 486 bp, Homo sapiens; identical to SEQ ID NO: 535043
  misc_feature: HIJSMM301A3WF9.46.35.D02.1.454.light.4.raw

SEQ ID NO: 543912 - DNA, 495 bp, Homo sapiens
  misc_feature: HIJSMM301AGZ5P.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactagtggctgcaccatctgtcttcat

SEQ ID NO: 543913 - DNA, 502 bp, Homo sapiens
  misc_feature: HIJSMM301BKE73.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccgccta

SEQ ID NO: 543914 - DNA, 516 bp, Homo sapiens
  misc_feature: HIJSMM301ECRLO.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcct

SEQ ID NO: 543915 - DNA, 464 bp, Homo sapiens; identical to SEQ ID NO: 539492
  misc_feature: HIJSMM301C6DE3.18.59.F04.1.454.light.4.raw

SEQ ID NO: 543916 - DNA, 502 bp, Homo sapiens
  misc_feature: HIJSMM301DV12O.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatccttcccgccat

SEQ ID NO: 543917 - DNA, 443 bp, Homo sapiens
  misc_feature: HIJSMM301DB4GF.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactcgttcccaccctcctcagacgtatca

SEQ ID NO: 543918 - DNA, 494 bp, Homo sapiens; identical to SEQ ID NO: 535629
  misc_feature: HIJSMM301B1917.4.27.C05.1.454.light.4.raw

SEQ ID NO: 543919 - DNA, 494 bp, Homo sapiens
  misc_feature: HIJSMM301CULRJ.22.86.H09.1.454.light.4.raw
  modified_base (418)..(418): a, c, t, g, unknown or other
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggnggagggaccaagctgaccgtctaggtcagcccaaggctgccccctcggtcactctgttcccaccctcctcacgtcg

SEQ ID NO: 543920 - DNA, 493 bp, Homo sapiens
  misc_feature: HIJSMM301CVSNT.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtaatgaaaatgtcccgctcactttcggcgggggaccaaggtggagttcaacgaactgtggctgcaccatctgtcttcat

SEQ ID NO: 543921 - DNA, 495 bp, Homo sapiens
  misc_feature: HIJSMM301BRLOO.51.34.D01.1.454.light.4.raw
cgatcgtatacacgaccggtgctcgatttagatcgtctgtgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcact

SEQ ID NO: 543922 - DNA, 499 bp, Homo sapiens
  misc_feature: HIJSMM301CLA5D.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgacta

SEQ ID NO: 543923 - DNA, 486 bp, Homo sapiens
  misc_feature: HIJSMM301DHB33.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcaccta

SEQ ID NO: 543924 - DNA, 497 bp, Homo sapiens; identical to SEQ ID NO: 535286
  misc_feature: HIJSMM301AEVVA.18.59.F04.1.454.light.4.raw

SEQ ID NO: 543925 - DNA, 447 bp, Homo sapiens; identical to SEQ ID NO: 535201
  misc_feature: HIJSMM301EBKG5.18.9.A09.1.454.light.4.raw

SEQ ID NO: 543926 - DNA, 518 bp, Homo sapiens
  misc_feature: HIJSMM301CCHU3.51.53.E09.1.454.light.4.raw
cgatcgtatacacgaccggtgctcgatttagagagagtgtgttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccaaactgaccgtcctacgtcagcccaaggctgccccctcggtcactctgttccccg

SEQ ID NO: 543927 - DNA, 490 bp, Homo sapiens
  misc_feature: HIJSMM301BE7M1.48.10.A10.1.454.light.4.raw
agtatacatacacgaccggtgctcgatttagcgtcgatctcaggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccgagggtaggaaagtacaaacgaaactagtggctgcaccatctgtcttt

SEQ ID NO: 543928 - DNA, 477 bp, Homo sapiens
  misc_feature: HIJSMM301A1LB3.16.86.H09.1.454.light.4.raw
tgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 543929 - DNA, 493 bp, Homo sapiens
  misc_feature: HIJSMM301BSOXF.41.16.B05.1.454.light.4.raw
tctatactatcacgaccggtgctcgatttagagctcacgtaagggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagtttattactgtcaccaatataataactggtacacttttggccaggggaccaagctcgagatcaaacgaactgtggctgcaccatctgtcttcatcttcccg

SEQ ID NO: 543930 - DNA, 491 bp, Homo sapiens; identical to SEQ ID NO: 535294
  misc_feature: HIJSMM301A44JP.16.68.G02.1.454.light.4.raw

SEQ ID NO: 543931 - DNA, 495 bp, Homo sapiens
  misc_feature: HIJSMM301EFVIF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctccctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtattttgcagtctattactgtcagcagtatggtcaccgtacccaagtaacttttcggccgacgggaccgaagctggagatacaaacgaactgtggctgcaccat

SEQ ID NO: 543932 - DNA, 505 bp, Homo sapiens; identical to SEQ ID NO: 536254
  misc_feature: HIJSMM301DD528.7.71.G05.1.454.light.4.raw

SEQ ID NO: 543933 - DNA, 510 bp, Homo sapiens
  misc_feature: HIJSMM301B8MK1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtaggaaatacaaacgaacctagtggctgcaccactctgtcttctactcttccccg

SEQ ID NO: 543934 - DNA, 482 bp, Homo sapiens; identical to SEQ ID NO: 535955
  misc_feature: HIJSMM301BEFBA.46.26.C04.1.454.light.4.raw

SEQ ID NO: 543935 - DNA, 504 bp, Homo sapiens; identical to SEQ ID NO: 535561
  misc_feature: HIJSMM301DLDG3.4.57.F02.1.454.light.4.raw

SEQ ID NO: 543936 - DNA, 502 bp, Homo sapiens
  misc_feature: HIJSMM301C35A2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactc

SEQ ID NO: 543937 - DNA, 506 bp, Homo sapiens; identical to SEQ ID NO: 534969
  misc_feature: HIJSMM301AV24K.18.37.D04.1.454.light.4.raw

SEQ ID NO: 543938 - DNA, 503 bp, Homo sapiens
  misc_feature: HIJSMM301DBCE4.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtcactctgtt

SEQ ID NO: 543939 - DNA, 493 bp, Homo sapiens
  misc_feature: HIJSMM301BE70U.52.82.H05.1.454.light.4.raw
cgcagtacgacacgaccggtgctcgatttagtcgagctctctcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcggaactgggaccaaggtcaccgtcctaggtcagcccaaggcccaacccactgtca

SEQ ID NO: 543940 - DNA, 478 bp, Homo sapiens
  misc_feature: HIJSMM301ADRQ1.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaggttaacactgtggatcaccttcggccaagggacacgactggagattaaacgaactgtggctgcaccatctgtcttcatcttcccgccatctgaagtatagtct

SEQ ID NO: 543941 - DNA, 493 bp, Homo sapiens
  misc_feature: HIJSMM301AYOAC.19.71.G05.1.454.light.4.raw
tactctcgtgcacgaccggtgctcgatttagtgtcgtcgcaagagagaggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaactgtgg

SEQ ID NO: 543942 - DNA, 456 bp, Homo sapiens
  misc_feature: HIJSMM301CT75L.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctccggtcgactctgttcccaccctcctccaccgagagta

SEQ ID NO: 543943 - DNA, 497 bp, Homo sapiens
  misc_feature: HIJSMM301A4RLJ.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgcatctgaca

SEQ ID NO: 543944 - DNA, 474 bp, Homo sapiens
  misc_feature: HIJSMM301A18TZ.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtgg

SEQ ID NO: 543945 - DNA, 478 bp, Homo sapiens; identical to SEQ ID NO: 535449
  misc_feature: HIJSMM301C73JB.40.59.F04.1.454.light.4.raw

SEQ ID NO: 543946 - DNA, 486 bp, Homo sapiens; identical to SEQ ID NO: 535458
  misc_feature: HIJSMM301ADZWF.7.75.G09.1.454.light.4.raw

SEQ ID NO: 543947 - DNA, 502 bp, Homo sapiens
  misc_feature: HIJSMM301DA63S.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctcgggaccaaagtggagatcaaacgaactgtggctgcaccatctgtcttcta

SEQ ID NO: 543948 - DNA, 494 bp, Homo sapiens
  misc_feature: HIJSMM301BFWTQ.49.52.E08.1.454.light.4.raw
agtcgagagacacgaccggtgctcgatttagtcgagctctcagagagaaaggggggtccaggaggtcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcta

SEQ ID NO: 543949 - DNA, 493 bp, Homo sapiens
  misc_feature: HIJSMM301DJCDJ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcattcc

SEQ ID NO: 543950 - DNA, 512 bp, Homo sapiens; identical to SEQ ID NO: 535484
  misc_feature: HIJSMM301A7AYO.8.23.C01.1.454.light.4.raw

SEQ ID NO: 543951 - DNA, 496 bp, Homo sapiens; identical to SEQ ID NO: 535109
  misc_feature: HIJSMM301D3GYG.16.78.H01.1.454.light.4.raw

SEQ ID NO: 543952 - DNA, 463 bp, Homo sapiens; identical to SEQ ID NO: 535062
  misc_feature: HIJSMM301DANU9.11.73.G07.1.454.light.4.raw

SEQ ID NO: 543953 - DNA, 477 bp, Homo sapiens; identical to SEQ ID NO: 537678
  misc_feature: HIJSMM301AZO9U.12.1.A01.1.454.light.4.raw

SEQ ID NO: 543954 - DNA, 486 bp, Homo sapiens; identical to SEQ ID NO: 537428
  misc_feature: HIJSMM301AJRWV.47.62.F07.1.454.light.4.raw

SEQ ID NO: 543955 - DNA, 496 bp, Homo sapiens
  misc_feature: HIJSMM301DT1B7.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaaactgtggctgcaccatctgtcttcatt

SEQ ID NO: 543956 - DNA, 480 bp, Homo sapiens; identical to SEQ ID NO: 535291
  misc_feature: HIJSMM301AL3PG.22.59.F04.1.454.light.4.raw

SEQ ID NO: 543957 - DNA, 493 bp, Homo sapiens; identical to SEQ ID NO: 535047
  misc_feature: HIJSMM301BG49J.16.53.E09.1.454.light.4.raw

SEQ ID NO: 543958 - DNA, 494 bp, Homo sapiens; identical to SEQ ID NO: 534992
  misc_feature: HIJSMM301AT8MS.9.1.A01.1.454.light.4.raw

SEQ ID NO: 543959 - DNA, 479 bp, Homo sapiens
  misc_feature: HIJSMM301ER6RU.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccggcggtggagatcagacgaactgtggctgcaccatctgtctt

SEQ ID NO: 543960 - DNA, 503 bp, Homo sapiens; identical to SEQ ID NO: 542867
  misc_feature: HIJSMM301BOYQP.14.57.F02.1.454.light.4.raw

SEQ ID NO: 543961 - DNA, 518 bp, Homo sapiens; identical to SEQ ID NO: 539372
  misc_feature: HIJSMM301BQEWJ.7.86.H09.1.454.light.4.raw

SEQ ID NO: 543962 - DNA, 482 bp, Homo sapiens; identical to SEQ ID NO: 537205
  misc_feature: HIJSMM301A3FMP.5.39.D06.1.454.light.4.raw

SEQ ID NO: 543963 - DNA, 488 bp, Homo sapiens
  misc_feature: HIJSMM301BO1HZ.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatggtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgt

SEQ ID NO: 543964 - DNA, 460 bp, Homo sapiens; identical to SEQ ID NO: 536053
  misc_feature: HIJSMM301AI014.22.28.C06.1.454.light.4.raw

SEQ ID NO: 543965 - DNA, 496 bp, Homo sapiens
  misc_feature: HIJSMM301ER5O8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaacggacggagatcagacgaactagtggcgtgcaccaatctcgtcttcta

SEQ ID NO: 543966 - DNA, 447 bp, Homo sapiens; identical to SEQ ID NO: 535201
  misc_feature: HIJSMM301AVZ1F.18.9.A09.1.454.light.4.raw

SEQ ID NO: 543967 - DNA, 508 bp, Homo sapiens
  misc_feature: HIJSMM301BMFZG.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtgagtatcaaacgaactgtggctgcaccatctgtcttcta

SEQ ID NO: 543968 - DNA, 504 bp, Homo sapiens
  misc_feature: HIJSMM301CP4Z4.40.67.G01.1.454.light.4.raw
tctagcgactcacgaccggtgctcgatttagagtatacatattgggtttgggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgccat

SEQ ID NO: 543969 - DNA, 511 bp, Homo sapiens; identical to SEQ ID NO: 537464
  misc_feature: HIJSMM301BG73A.7.34.D01.1.454.light.4.raw

SEQ ID NO: 543970 - DNA, 302 bp, Homo sapiens
  misc_feature: HIJSMM301DJ16R.13.11.A11.1.454.light.4.raw
tcacgtactacacgaccggtgctcgatttagctacgactgcagggccagtcagattgtcagcagcaactacttagcctggtaccagcagaagcctggccaggcccccaggctcctcatctacgatgtattcaggaggaccactgaaatcccagacaggttcagtggcagtgggtctgggacagacttcactctcaccatcagcagactggaacctgaagactttgcactttatttctgtcaccagtatggaactgtggctgcaccatctgtcttcatcttcccgccatctgatagtacgtga

SEQ ID NO: 543971 - DNA, 476 bp, Homo sapiens
  misc_feature: HIJSMM301CIIAA.52.9.A09.1.454.light.4.raw
cgcagtacgacacgaccggtgctcgatttagcgagacgcgcagggggatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttattactgcatgcaagttctacaaaatcctcgcacttttggccaggggaccaagctggagatcaaacgaa

SEQ ID NO: 543972 - DNA, 490 bp, Homo sapiens
  misc_feature: HIJSMM301AFMD4.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaactgt

SEQ ID NO: 543973 - DNA, 513 bp, Homo sapiens; identical to SEQ ID NO: 535244
  misc_feature: HIJSMM301EJ23B.17.33.C11.1.454.light.4.raw

SEQ ID NO: 543974 - DNA, 509 bp, Homo sapiens
  misc_feature: HIJSMM301AE54X.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctggaccgaaacttagtagatcaaacgaactagtggctgcaccatctgtcttctatcttcccgcca

SEQ ID NO: 543975 - DNA, 486 bp, Homo sapiens; identical to SEQ ID NO: 536261
  misc_feature: HIJSMM301AQN7B.26.55.E11.1.454.light.4.raw

SEQ ID NO: 543976 - DNA, 493 bp, Homo sapiens
  misc_feature: HIJSMM301AWH9A.27.78.H01.1.454.light.4.raw
  modified_base (488)..(488): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggcacatttcaccctcaccatcaatagcctggaagctgaagatgctgcaacttattactgtcatcagagtactactttacctcaagtgatcaccttcggccaaggacacgactggagattaaacgaactgtggctgcaccatcngtctt

SEQ ID NO: 543977 - DNA, 486 bp, Homo sapiens
  misc_feature: HIJSMM301AQVN9.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagccactgatttcacactgaaaatcagcagggtggaggctgaggatgtcggggtttactactgcatgcagggtacactctggccgttcacttttggcctggggaccaaactggatatcagacgaactgtgg

SEQ ID NO: 543978 - DNA, 494 bp, Homo sapiens
  misc_feature: HIJSMM301EBL8G.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaaacctctacaaactgtgtggacggtcggccaagggaccaaggtggaaatcaagcgaactgtggctgcacca

SEQ ID NO: 543979 - DNA, 486 bp, Homo sapiens; identical to SEQ ID NO: 535043
  misc_feature: HIJSMM301DKRNM.46.35.D02.1.454.light.4.raw

SEQ ID NO: 543980 - DNA, 506 bp, Homo sapiens
  misc_feature: HIJSMM301AM1Q8.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccaaaataagaggtcaaacgaactagtggctgcaccatctgtcttcatt

SEQ ID NO: 543981 - DNA, 486 bp, Homo sapiens; identical to SEQ ID NO: 535523
  misc_feature: HIJSMM301EN206.22.73.G07.1.454.light.4.raw

SEQ ID NO: 543982 - DNA, 488 bp, Homo sapiens; identical to SEQ ID NO: 535725
  misc_feature: HIJSMM301CO5KI.12.88.H11.1.454.light.4.raw

SEQ ID NO: 543983 - DNA, 495 bp, Homo sapiens
  misc_feature: HIJSMM301DTZ2A.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccaggatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggccaggggactaagctggagatcaaacgaactgtggctgcaccatctgtcttcatcttcccg

SEQ ID NO: 543984 - DNA, 447 bp, Homo sapiens; identical to SEQ ID NO: 535201
  misc_feature: HIJSMM301DOGA8.18.9.A09.1.454.light.4.raw

SEQ ID NO: 543985 - DNA, 491 bp, Homo sapiens
  misc_feature: HIJSMM301EKDVP.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccaagggaccaaggtggaaagtcaacgaactgtggctgcaccat

SEQ ID NO: 543986 - DNA, 500 bp, Homo sapiens
  misc_feature: HIJSMM301AG80C.41.26.C04.1.454.light.4.raw
tctatactatcacgaccggtgctcgatttagtctagcgactttgggtttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttc

SEQ ID NO: 543987 - DNA, 494 bp, Homo sapiens; identical to SEQ ID NO: 534992
  misc_feature: HIJSMM301BJFGQ.9.1.A01.1.454.light.4.raw

SEQ ID NO: 543988 - DNA, 513 bp, Homo sapiens
  misc_feature: HIJSMM301DUQPO.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccacggaccgaacggtaggaaagtacaagacgaactgtggcgtgcgaccactctgtcttctactcttcccgt

SEQ ID NO: 543989 - DNA, 499 bp, Homo sapiens
  misc_feature: HIJSMM301DB4NI.52.27.C05.1.454.light.4.raw
cgcagtacgacacgaccggtgctcgatttagacgcgatcgaagggtttgggcacgaccggtgctcgatttagacgcgatcgaagggtttgggggtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctggaccagagtggatata

SEQ ID NO: 543990 - DNA, 501 bp, Homo sapiens; identical to SEQ ID NO: 536867
  misc_feature: HIJSMM301DHEQU.5.86.H09.1.454.light.4.raw

SEQ ID NO: 543991 - DNA, 441 bp, Homo sapiens; identical to SEQ ID NO: 535074
  misc_feature: HIJSMM301DB1DV.11.3.A03.1.454.light.4.raw

SEQ ID NO: 543992 - DNA, 498 bp, Homo sapiens
  misc_feature: HIJSMM301ESWPI.40.42.D09.1.454.light.4.raw
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtctaggtcagcccaaggctgccccctcggtca

SEQ ID NO: 543993 - DNA, 506 bp, Homo sapiens
  misc_feature: HIJSMM301EEBOJ.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 543994 - DNA, 486 bp, Homo sapiens; identical to SEQ ID NO: 536323
  misc_feature: HIJSMM301DKSJE.10.2.A02.1.454.light.4.raw

SEQ ID NO: 543995 - DNA, 496 bp, Homo sapiens
  misc_feature: HIJSMM301EMYKT.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagttttaccctcacaactcatatcacagaatctgaggatgctgcattttacttcggtctacaacatgataatttccctccgtggacgttcggccaagggaccaaggagcaaatcaaacgaactgtggctgcaccatctgtcttcatcttcccgccat

SEQ ID NO: 543996 - DNA, 494 bp, Homo sapiens
  misc_feature: HIJSMM301CD8HD.43.61.F06.1.454.light.4.raw
tgtgagtagtcacgaccggtgctcgatttagctacgctctaaggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaactgtggctgcaccatctgtctt

SEQ ID NO: 543997 - DNA, 501 bp, Homo sapiens; identical to SEQ ID NO: 536867
  misc_feature: HIJSMM301DQUK8.5.86.H09.1.454.light.4.raw

SEQ ID NO: 543998 - DNA, 520 bp, Homo sapiens
  misc_feature: HIJSMM301C5TET.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccaccct

SEQ ID NO: 543999 - DNA, 489 bp, Homo sapiens; identical to SEQ ID NO: 535139
  misc_feature: HIJSMM301ESF2S.14.55.E11.1.454.light.4.raw

SEQ ID NO: 544000 - DNA, 479 bp, Homo sapiens; identical to SEQ ID NO: 537163
  misc_feature: HIJSMM301DLPU5.13.73.G07.1.454.light.4.raw

SEQ ID NO: 544001 - DNA, 491 bp, Homo sapiens; identical to SEQ ID NO: 536211
  misc_feature: HIJSMM301CDJEE.16.53.E09.1.454.light.4.raw

SEQ ID NO: 544002 - DNA, 484 bp, Homo sapiens
  misc_feature: HIJSMM301AQSPI.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggagtat

SEQ ID NO: 544003 - DNA, 495 bp, Homo sapiens
  misc_feature: HIJSMM301DVM6O.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccacccagtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 544004 - DNA, 488 bp, Homo sapiens; identical to SEQ ID NO: 543022
  misc_feature: HIJSMM301BI8SI.9.59.F04.1.454.light.4.raw

SEQ ID NO: 544005 - DNA, 495 bp, Homo sapiens
  misc_feature: HIJSMM301CJ37Y.52.56.F01.1.454.light.4.raw
cgcagtacgacacgaccggtgctcgatttagcagacgtctgaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgt

SEQ ID NO: 544006 - DNA, 491 bp, Homo sapiens
  misc_feature: HIJSMM301AVMCF.5.48.E04.1.454.light.4.raw
atcagacacgcacgaccggtgctcgatttagagagcgtcacagagagaaggggagagggaaccatggaaacccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggaccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgctacctttcacttttcggcggtagggaccaaggtggagagcagacgaactgtggctgcaccatctgtcttcatcttcccgccact

SEQ ID NO: 544007 - DNA, 507 bp, Homo sapiens
  misc_feature: HIJSMM301D5DJK.41.35.D02.1.454.light.4.raw
tctatactatcacgaccggtgctcgatttagcacacgatagttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaacgcccccaaactcctgatttatggagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 544008 - DNA, 498 bp, Homo sapiens
  misc_feature: HIJSMM301C0KCV.40.65.F10.1.454.light.4.raw
tctagcgactcacgaccggtgctcgatttagctacgctctaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgc

SEQ ID NO: 544009 - DNA, 490 bp, Homo sapiens; identical to SEQ ID NO: 535420
  misc_feature: HIJSMM301BH4S3.3.72.G06.1.454.light.4.raw

SEQ ID NO: 544010 - DNA, 483 bp, Homo sapiens
  misc_feature: HIJSMM301E1NWE.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcaccatctgtcttc

SEQ ID NO: 544011 - DNA, 509 bp, Homo sapiens; identical to SEQ ID NO: 536047
  misc_feature: HIJSMM301EBMWR.17.33.C11.1.454.light.4.raw

SEQ ID NO: 544012 - DNA, 498 bp, Homo sapiens
  misc_feature: HIJSMM301DOYTW.9.1.A01.1.454.light.4.raw
tgatacgtctcacgaccggtgctcgatttagacgtctcatcagggggaggctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacggacgactggagattaaaggaacgtgtggctgcaccatctgtcttcatcttccccg

SEQ ID NO: 544013 - DNA, 501 bp, Homo sapiens; identical to SEQ ID NO: 535746
  misc_feature: HIJSMM301B5GYF.18.11.A11.1.454.light.4.raw

SEQ ID NO: 544014 - DNA, 383 bp, Homo sapiens; identical to SEQ ID NO: 447524
  misc_feature: HIJSMM301AM2NU.41.26.C04.1.454.light.4.raw

SEQ ID NO: 544015 - DNA, 480 bp, Homo sapiens
  misc_feature: HIJSMM301C75PF.43.55.E11.1.454.light.4.raw
tgtgagtagtcacgaccggtgctcgatttagcactcgcacgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtccta

SEQ ID NO: 544016 - DNA, 497 bp, Homo sapiens; identical to SEQ ID NO: 536376
  misc_feature: HIJSMM301CLAWQ.22.9.A09.1.454.light.4.raw

SEQ ID NO: 544017 - DNA, 479 bp, Homo sapiens
  misc_feature: HIJSMM301D64NB.8.53.E09.1.454.light.4.raw
  modified_base (456)..(456): a, c, t, g, unknown or other
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgaagtntttggctgttcggcggcgggacc

SEQ ID NO: 544018 - DNA, 503 bp, Homo sapiens
  misc_feature: HIJSMM301CRBRQ.4.10.A10.1.454.light.4.raw
agcactgtagcacgaccggtgctcgatttagcgtcgatctcaggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggaggaccaagttgaccgtcgtggtcagccaaggctgccccctcggtcactctcgtcccgt

SEQ ID NO: 544019 - DNA, 496 bp, Homo sapiens; identical to SEQ ID NO: 538149
  misc_feature: HIJSMM301CGYSL.13.67.G01.1.454.light.4.raw

SEQ ID NO: 544020 - DNA, 481 bp, Homo sapiens
  misc_feature: HIJSMM301D7EF9.51.53.E09.1.454.light.4.raw
cgatcgtatacacgaccggtgctcgatttagagagagtgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcgggggaccaaggtggagaatcaagcgaactgtggctgcaccatctgtt

SEQ ID NO: 544021 - DNA, 514 bp, Homo sapiens
  misc_feature: HIJSMM301ADKSW.41.26.C04.1.454.light.4.raw
tctatactatcacgaccggtgctcgatttagtctagcgactttgggtttggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagttcacctctaacttcggcggagggaccgaaggtaggagatacaaacgaactagtggctgcaccatctcgtcttctatcttcccgtccta

SEQ ID NO: 544022 - DNA, 506 bp, Homo sapiens; identical to SEQ ID NO: 536416
  misc_feature: HIJSMM301DKU2H.43.86.H09.1.454.light.4.raw

SEQ ID NO: 544023 - DNA, 494 bp, Homo sapiens; identical to SEQ ID NO: 534992
  misc_feature: HIJSMM301D5Z0Y.9.1.A01.1.454.light.4.raw

SEQ ID NO: 544024 - DNA, 482 bp, Homo sapiens
  misc_feature: HIJSMM301CTHAV.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggcctgggactaaggtggagatcagacgaactgtggctgcaccatctgtcttc

SEQ ID NO: 544025 - DNA, 482 bp, Homo sapiens
  misc_feature: HIJSMM301B06EH.49.38.D05.1.454.light.4.raw
  modified_base (479)..(479): a, c, t, g, unknown or other
agtcgagagacacgaccggtgctcgatttagtatctgatagttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcacttcggtcggagggaccaaggtggagatcaaacgaactgtggctgnacc

SEQ ID NO: 544026 - DNA, 488 bp, Homo sapiens
  misc_feature: HIJSMM301D3F28.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcgagggaccaaggcggagatcagacgaactgtggctgcaccatctgtcttcta

SEQ ID NO: 544027 - DNA, 479 bp, Homo sapiens
  misc_feature: HIJSMM301A4M44.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcgggagggaccgcggtggagatcagacgaactgtggctgcaccatctgtctt

SEQ ID NO: 544028 - DNA, 488 bp, Homo sapiens
  misc_feature: HIJSMM301DRDNU.53.22.B11.1.454.light.4.raw
cgcgtatacacacgaccggtgctcgatttagacgacagctcagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctaggtcagcccaaggccaacccactgtcact

SEQ ID NO: 544029 - DNA, 494 bp, Homo sapiens; identical to SEQ ID NO: 534992
  misc_feature: HIJSMM301BCPLJ.9.1.A01.1.454.light.4.raw

SEQ ID NO: 544030 - DNA, 495 bp, Homo sapiens
  misc_feature: HIJSMM301BV3EI.52.29.C07.1.454.light.4.raw
cgcagtacgacacgaccggtgctcgatttagagtgctacgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcact

SEQ ID NO: 544031 - DNA, 422 bp, Homo sapiens; identical to SEQ ID NO: 539580
  misc_feature: HIJSMM301B3443.41.12.B01.1.454.light.4.raw

SEQ ID NO: 544032 - DNA, 514 bp, Homo sapiens
  misc_feature: HIJSMM301DCU1P.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaagtcaaacgaactacgtggctgcaccatctgtcttctactcttcccgccact

SEQ ID NO: 544033 - DNA, 488 bp, Homo sapiens
  misc_feature: HIJSMM301BKLHM.48.35.D02.1.454.light.4.raw
agtatacatacacgaccggtgctcgatttagcacacgatagttgggtttgggggagtcagacccactcaggacacagcatggacatgagggtcccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccaaggtcggaagtacaaacgaactacgtggctgcaccta

SEQ ID NO: 544034 - DNA, 503 bp, Homo sapiens; identical to SEQ ID NO: 535044
  misc_feature: HIJSMM301A4ZQK.19.78.H01.1.454.light.4.raw

SEQ ID NO: 544035 - DNA, 454 bp, Homo sapiens; identical to SEQ ID NO: 535005
  misc_feature: HIJSMM301C8NLU.19.86.H09.1.454.light.4.raw

SEQ ID NO: 544036 - DNA, 488 bp, Homo sapiens
  misc_feature: HIJSMM301CRAYN.53.10.A10.1.454.light.4.raw
  modified_base (460)..(460): a, c, t, g, unknown or other
  modified_base (469)..(469): a, c, t, g, unknown or other
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcggggacggaacaagcgacctcgtgcnccacgagcncccgcccgtgactctcgtt

SEQ ID NO: 544037 - DNA, 454 bp, Homo sapiens; identical to SEQ ID NO: 536325
  misc_feature: HIJSMM301CNRN1.19.86.H09.1.454.light.4.raw
  modified_base (436)..(436): a, c, t, g, unknown or other

SEQ ID NO: 544038 - DNA, 502 bp, Homo sapiens; identical to SEQ ID NO: 536253
  misc_feature: HIJSMM301BEO3B.21.22.B11.1.454.light.4.raw

SEQ ID NO: 544039 - DNA, 490 bp, Homo sapiens
  misc_feature: HIJSMM301BOX5U.43.25.C03.1.454.light.4.raw
tgtgagtagtcacgaccggtgctcgatttagtagtgtagatttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtgaggctgaggatgttgggtttattactgcatgcaaggtacacactggcccgtcaccttcggccaagggacacgactggagattaaacgaactgtgg

SEQ ID NO: 544040 - DNA, 490 bp, Homo sapiens
  misc_feature: HIJSMM301AIAEB.41.23.C01.1.454.light.4.raw
  modified_base (444)..(444): a, c, t, g, unknown or other
tctatactatcacgaccggtgctcgatttagtacacgtgattagggattgggggcaggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttattttgttcaacagctaatagttcctcaacatcggtcccnggacgagagtggatttagtagacgaactgtggcgtgcaccatctgt

SEQ ID NO: 544041 - DNA, 521 bp, Homo sapiens; identical to SEQ ID NO: 538715
  misc_feature: HIJSMM301BFTRP.27.23.C01.1.454.light.4.raw

SEQ ID NO: 544042 - DNA, 453 bp, Homo sapiens
  misc_feature: HIJSMM301DZ9JN.19.86.H09.1.454.light.4.raw
  modified_base (435)..(435): a, c, t, g, unknown or other
tactctcgtgcacgaccggtgctcgatttagtgctatagacttgggtttggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccnccctcctccacgagagta

SEQ ID NO: 544043 - DNA, 433 bp, Homo sapiens; identical to SEQ ID NO: 542559
  misc_feature: HIJSMM301DX0JL.41.8.A08.1.454.light.4.raw

SEQ ID NO: 544044 - DNA, 457 bp, Homo sapiens
  misc_feature: HIJSMM301CY1US.48.73.G07.1.454.light.4.raw
agtatacatacacgaccggtgctcgatttagctctacgctcagggcacgaccggtgctcgatttagctacgactgcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcagggtccctgatcgcttctctggctccagtctggcaacacggcctccctgacccatctctgggctccaggctgaggatgaggctgattattactgctg

SEQ ID NO: 544045 - DNA, 485 bp, Homo sapiens; identical to SEQ ID NO: 535880
  misc_feature: HIJSMM301AKKCM.7.75.G09.1.454.light.4.raw

SEQ ID NO: 544046 - DNA, 490 bp, Homo sapiens; identical to SEQ ID NO: 535234
  misc_feature: HIJSMM301ADY9F.17.21.B10.1.454.light.4.raw

SEQ ID NO: 544047 - DNA, 521 bp, Homo sapiens; identical to SEQ ID NO: 539470
  misc_feature: HIJSMM301EHRC2.27.23.C01.1.454.light.4.raw

SEQ ID NO: 544048 - DNA, 448 bp, Homo sapiens; identical to SEQ ID NO: 540364
  misc_feature: HIJSMM301ALZCJ.18.9.A09.1.454.light.4.raw

SEQ ID NO: 544049 - DNA, 444 bp, Homo sapiens; identical to SEQ ID NO: 535192
  misc_feature: HIJSMM301BH2YK.5.9.A09.1.454.light.4.raw

SEQ ID NO: 544050 - DNA, 503 bp, Homo sapiens; identical to SEQ ID NO: 536834
  misc_feature: HIJSMM301CPG2I.2.35.D02.1.454.light.4.raw

SEQ ID NO: 544051 - DNA, 487 bp, Homo sapiens
  misc_feature: HIJSMM301CCWBC.3.72.G06.1.454.light.4.raw
agacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatct

SEQ ID NO: 544052 - DNA, 492 bp, Homo sapiens
  misc_feature: HIJSMM301BQV9K.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcactccg

SEQ ID NO: 544053 - DNA, 494 bp, Homo sapiens; identical to SEQ ID NO: 534992
  misc_feature: HIJSMM301DQ9FZ.9.1.A01.1.454.light.4.raw

SEQ ID NO: 544054 - DNA, 503 bp, Homo sapiens; identical to SEQ ID NO: 535044
  misc_feature: HIJSMM301B01R3.19.78.H01.1.454.light.4.raw

SEQ ID NO: 544055 - DNA, 491 bp, Homo sapiens
  misc_feature: HIJSMM301A2A3T.52.85.H08.1.454.light.4.raw
cgcagtacgacacgaccggtgctcgatttagtatcactcagtcgcgggggcctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 544056 - DNA, 508 bp, Homo sapiens
  misc_feature: HIJSMM301BM97Y.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggtcggagggacccaggtgaccgtcctacgtcagccc

SEQ ID NO: 544057 - DNA, 473 bp, Homo sapiens
  misc_feature: HIJSMM301BU5JV.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgccctggactgaagtgcatatgaagagaactgtggctgca

SEQ ID NO: 544058 - DNA, 521 bp, Homo sapiens
  misc_feature: HIJSMM301BFQ8X.49.35.D02.1.454.light.4.raw
agtcgagagacacgaccggtgctcgatttagcacacgatagttgggtttgggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccacctcctctct

SEQ ID NO: 544059 - DNA, 478 bp, Homo sapiens
  misc_feature: HIJSMM301AYN3A.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaa

SEQ ID NO: 544060 - DNA, 481 bp, Homo sapiens; identical to SEQ ID NO: 535993
  misc_feature: HIJSMM301A56VC.21.25.C03.1.454.light.4.raw

SEQ ID NO: 544061 - DNA, 489 bp, Homo sapiens
  misc_feature: HIJSMM301BUU56.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgcttcagtttcggcggagggaccaaggtggagatcaaacgaactgtggctgcaccatctgtt

SEQ ID NO: 544062 - DNA, 488 bp, Homo sapiens; identical to SEQ ID NO: 539612
  misc_feature: HIJSMM301DGD2U.3.55.E11.1.454.light.4.raw

SEQ ID NO: 544063 - DNA, 500 bp, Homo sapiens
  misc_feature: HIJSMM301A7WW5.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccaaggtggagatcaagcgaactgtggctgcaccatctgtcttcatcttcccgccta

SEQ ID NO: 544064 - DNA, 484 bp, Homo sapiens; identical to SEQ ID NO: 535400
  misc_feature: HIJSMM301CQDBK.46.26.C04.1.454.light.4.raw

SEQ ID NO: 544065 - DNA, 506 bp, Homo sapiens
  misc_feature: HIJSMM301BNK17.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaacggtggaaatacaaacgaactgtggctgcaccatctgtcttctatcttccccg

SEQ ID NO: 544066 - DNA, 492 bp, Homo sapiens
  misc_feature: HIJSMM301EI1M2.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaagtaggacgatcaagcgaactgtggcgtgcaccatct

SEQ ID NO: 544067 - DNA, 383 bp, Homo sapiens; identical to SEQ ID NO: 447524
  misc_feature: HIJSMM301B24KD.41.26.C04.1.454.light.4.raw

SEQ ID NO: 544068 - DNA, 478 bp, Homo sapiens
  misc_feature: HIJSMM301EGYBM.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggccaaggtgcagatcaaacgaactgtgg

SEQ ID NO: 544069 - DNA, 494 bp, Homo sapiens; identical to SEQ ID NO: 534994
  misc_feature: HIJSMM301CNT8B.27.78.H01.1.454.light.4.raw

SEQ ID NO: 544070 - DNA, 478 bp, Homo sapiens; identical to SEQ ID NO: 535129
  misc_feature: HIJSMM301A4YKL.11.11.A11.1.454.light.4.raw

SEQ ID NO: 544071 - DNA, 474 bp, Homo sapiens
  misc_feature: HIJSMM301EUSH7.51.13.B02.1.454.light.4.raw
cgatcgtatacacgaccggtgctcgatttagtctagcgacttccgcggggcgggggcacttctccctctaacactctccctgctcagctcctggggctcctgctgctctggctctcaggtgccagatgtgacatccagatgtcccagtctccatcctccctgtctgcatctgttggagacagagtcaccatcacttgccagacaagtcacgacgttcgcagatatttaagctggtatcagcagagaccagggaaagcccctaaactcctgatatacgatgcatcccatttgggagcaggggtcccatcaagattcagtggaagtggatctgggacacattttactttcaccatcagtagcctgcagcctgaagatgtcgccacatattactgtcaacagcatgataatctctccaccttcggccaagggacacgactggaaattaaaacgagctgtggctgcaccatctgtctt

SEQ ID NO: 544072 - DNA, 499 bp, Homo sapiens
  misc_feature: HIJSMM301A6INP.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttcggccaagggacacgactggagattaaacgaactgtggctgcaccatctgtcttcatcttcccg

SEQ ID NO: 544073 - DNA, 497 bp, Homo sapiens; identical to SEQ ID NO: 535286
  misc_feature: HIJSMM301C1MWZ.18.59.F04.1.454.light.4.raw

SEQ ID NO: 544074 - DNA, 484 bp, Homo sapiens; identical to SEQ ID NO: 538247
  misc_feature: HIJSMM301BOZOU.14.53.E09.1.454.light.4.raw

SEQ ID NO: 544075 - DNA, 494 bp, Homo sapiens; identical to SEQ ID NO: 534992
  misc_feature: HIJSMM301DE5UN.9.1.A01.1.454.light.4.raw

SEQ ID NO: 544076 - DNA, 446 bp, Homo sapiens; identical to SEQ ID NO: 537066
  misc_feature: HIJSMM301DIEBN.18.9.A09.1.454.light.4.raw

SEQ ID NO: 544077 - DNA, 477 bp, Homo sapiens; identical to SEQ ID NO: 535122
  misc_feature: HIJSMM301CY79S.26.72.G06.1.454.light.4.raw

SEQ ID NO: 544078 - DNA, 494 bp, Homo sapiens; identical to SEQ ID NO: 534992
  misc_feature: HIJSMM301BAA16.9.1.A01.1.454.light.4.raw

SEQ ID NO: 544079 - DNA, 500 bp, Homo sapiens
  misc_feature: HIJSMM301AF0CC.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtcttcat

SEQ ID NO: 544080 - DNA, 513 bp, Homo sapiens
  misc_feature: HIJSMM301A13PW.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggtcaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctgttcccg

SEQ ID NO: 544081 - DNA, 416 bp, Homo sapiens; identical to SEQ ID NO: 535308
  misc_feature: HIJSMM301CSLBT.16.46.E02.1.454.light.4.raw

SEQ ID NO: 544082 - DNA, 502 bp, Homo sapiens
  misc_feature: HIJSMM301EZZ5H.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactagtggctgcaccatctgtcttcatcttcccgccta

SEQ ID NO: 544083 - DNA, 497 bp, Homo sapiens; identical to SEQ ID NO: 536371
  misc_feature: HIJSMM301BB8YL.16.78.H01.1.454.light.4.raw

SEQ ID NO: 544084 - DNA, 482 bp, Homo sapiens; identical to SEQ ID NO: 535352
  misc_feature: HIJSMM301AX7HK.16.81.H04.1.454.light.4.raw

SEQ ID NO: 544085 - DNA, 481 bp, Homo sapiens
  misc_feature: HIJSMM301D35QJ.4.36.D03.1.454.light.4.raw
agcactgtagcacgaccggtgctcgatttagctgcgtcacgatctctcttggggagtcagactcagtcaggacacagcatggacttgagggtccccgctcagctcctggggctcctgctgctctggctcccaggtgccaaatgtgacatccagatgacccagtctccttccaccctgtctgcatctgtgggggacagagtcaccatcacttgccgggccagtcagagtgttgataactggttggcctggtatcagcagaaaccagggaaagcccctaaactcctgatttatgatgcctcggtttgaaagtgggtcccatcaaggttcagcggcagtggatctgggacagaattcactctcaccatcagcagcctgcagcctgatgattttgcaacttattactgccaacagtattatagttattctttgacgttcggccaagggaccaaggtggaaatcaaacgaactgtggctgcaccat

SEQ ID NO: 544086 - DNA, 491 bp, Homo sapiens
  misc_feature: HIJSMM301CTF49.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagattttctctcgtcatcactggtctacagtctgacgacggcgcaatgtacttctgtcaacactatgcctctcccccctacaactttcggtcagggaccaagttgaacatcaatcgaactgtggctgcaccatctgtctt

SEQ ID NO: 544087 - DNA, 488 bp, Homo sapiens; identical to SEQ ID NO: 536554
  misc_feature: HIJSMM301DZB5H.26.37.D04.1.454.light.4.raw

SEQ ID NO: 544088 - DNA, 488 bp, Homo sapiens; identical to SEQ ID NO: 537260
  misc_feature: HIJSMM301DCJL0.47.70.G04.1.454.light.4.raw

SEQ ID NO: 544089 - DNA, 441 bp, Homo sapiens; identical to SEQ ID NO: 535074
  misc_feature: HIJSMM301D1WID.11.3.A03.1.454.light.4.raw

SEQ ID NO: 544090 - DNA, 513 bp, Homo sapiens
  misc_feature: HIJSMM301D94AN.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccacct

SEQ ID NO: 544091 - DNA, 490 bp, Homo sapiens
  misc_feature: HIJSMM301DRU9B.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaattcggtggagggaccaaggtggaggtcaaacgaactgtggctgcaccatctgtcttcta

SEQ ID NO: 544092 - DNA, 497 bp, Homo sapiens
  misc_feature: HIJSMM301CNDGN.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctggtcactctgttcccaccctcctctgtcgagcgt

SEQ ID NO: 544093 - DNA, 494 bp, Homo sapiens
  misc_feature: HIJSMM301DK5OQ.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactagtggctgcaccatctgtcttcat

SEQ ID NO: 544094 - DNA, 491 bp, Homo sapiens; identical to SEQ ID NO: 535194
  misc_feature: HIJSMM301AP5NT.26.78.H01.1.454.light.4.raw

SEQ ID NO: 544095 - DNA, 487 bp, Homo sapiens; identical to SEQ ID NO: 536206
  misc_feature: HIJSMM301EN259.47.38.D05.1.454.light.4.raw

SEQ ID NO: 544096 - DNA, 485 bp, Homo sapiens; identical to SEQ ID NO: 535880
  misc_feature: HIJSMM301APB8Q.7.75.G09.1.454.light.4.raw

SEQ ID NO: 544097 - DNA, 484 bp, Homo sapiens
  misc_feature: HIJSMM301EOAPQ.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatct

SEQ ID NO: 544098 - DNA, 494 bp, Homo sapiens; identical to SEQ ID NO: 534994
  misc_feature: HIJSMM301D4QZS.27.78.H01.1.454.light.4.raw

SEQ ID NO: 544099 - DNA, 494 bp, Homo sapiens; identical to SEQ ID NO: 534994
  misc_feature: HIJSMM301DH466.27.78.H01.1.454.light.4.raw

SEQ ID NO: 544100 - DNA, 483 bp, Homo sapiens; identical to SEQ ID NO: 536202
  misc_feature: HIJSMM301ASTLH.43.24.C02.1.454.light.4.raw

SEQ ID NO: 544101 - DNA, 494 bp, Homo sapiens
  misc_feature: HIJSMM301COVXO.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagagtggaggctgaggatgttggggtttattactgcatgcaagctctacaaattcctcggacgttcggccaagggaccgaaggtggaaatcaaacgaactagtggctgcacc

SEQ ID NO: 544102 - DNA, 494 bp, Homo sapiens; identical to SEQ ID NO: 534992
  misc_feature: HIJSMM301BDNMM.9.1.A01.1.454.light.4.raw

SEQ ID NO: 544103 - DNA, 503 bp, Homo sapiens; identical to SEQ ID NO: 538884
  misc_feature: HIJSMM301AQ22N.27.78.H01.1.454.light.4.raw

SEQ ID NO: 544104 - DNA, 488 bp, Homo sapiens; identical to SEQ ID NO: 538291
  misc_feature: HIJSMM301CCQSR.19.71.G05.1.454.light.4.raw

SEQ ID NO: 544105 - DNA, 494 bp, Homo sapiens; identical to SEQ ID NO: 534994
  misc_feature: HIJSMM301CYV9C.27.78.H01.1.454.light.4.raw

SEQ ID NO: 544106 - DNA, 506 bp, Homo sapiens
  misc_feature: HIJSMM301ELDYJ.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaaggtggagatcaaacgaactgtggctgcaccatctgtcttcatcttcccgccat

SEQ ID NO: 544107 - DNA, 493 bp, Homo sapiens
  misc_feature: HIJSMM301AFQJ3.49.20.B09.1.454.light.4.raw
agtcgagagacacgaccggtgctcgatttagtgtagtgtgaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctcggtcactc

SEQ ID NO: 544108 - DNA, 499 bp, Homo sapiens; identical to SEQ ID NO: 536578
  misc_feature: HIJSMM301BC72K.22.27.C05.1.454.light.4.raw

SEQ ID NO: 544109 - DNA, 495 bp, Homo sapiens
  misc_feature: HIJSMM301C47IH.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccacctcct

SEQ ID NO: 544110 - DNA, 493 bp, Homo sapiens; identical to SEQ ID NO: 535047
  misc_feature: HIJSMM301BX630.16.53.E09.1.454.light.4.raw

SEQ ID NO: 544111 - DNA, 495 bp, Homo sapiens
  misc_feature: HIJSMM301AEE77.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggtcggagggaccgagggtggagatcaaacgaactgtggctgcaccatctgtcttcatt

SEQ ID NO: 544112 - DNA, 510 bp, Homo sapiens
  misc_feature: HIJSMM301CFQ97.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcgggcgggggaccgaggtaggagttacaaacgaacgtgtggcgtgcaccactctcgtcttctatccttcccg

SEQ ID NO: 544113 - DNA, 504 bp, Homo sapiens; identical to SEQ ID NO: 542166
  misc_feature: HIJSMM301A7CFN.9.12.B01.1.454.light.4.raw
  modified_base (429)..(429): a, c, t, g, unknown or other

SEQ ID NO: 544114 - DNA, 488 bp, Homo sapiens; identical to SEQ ID NO: 535990
  misc_feature: HIJSMM301A3EQP.11.28.C06.1.454.light.4.raw

SEQ ID NO: 544115 - DNA, 509 bp, Homo sapiens; identical to SEQ ID NO: 542213
  misc_feature: HIJSMM301A8EBY.17.41.D08.1.454.light.4.raw

SEQ ID NO: 544116 - DNA, 497 bp, Homo sapiens; identical to SEQ ID NO: 536371
  misc_feature: HIJSMM301CXXGD.16.78.H01.1.454.light.4.raw

SEQ ID NO: 544117 - DNA, 490 bp, Homo sapiens; identical to SEQ ID NO: 541567
  misc_feature: HIJSMM301D8MUW.22.65.F10.1.454.light.4.raw

SEQ ID NO: 544118 - DNA, 488 bp, Homo sapiens; identical to SEQ ID NO: 543314
  misc_feature: HIJSMM301A4CMR.3.33.C11.1.454.light.4.raw

SEQ ID NO: 544119 - DNA, 487 bp, Homo sapiens
  misc_feature: HIJSMM301C403Z.48.61.F06.1.454.light.4.raw
agtatacatacacgaccggtgctcgatttagctacgctctaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaacgaactgtggctgcaccat

SEQ ID NO: 544120 - DNA, 497 bp, Homo sapiens; identical to SEQ ID NO: 535664
  misc_feature: HIJSMM301D0GJP.22.14.B03.1.454.light.4.raw

SEQ ID NO: 544121 - DNA, 494 bp, Homo sapiens; identical to SEQ ID NO: 534994
  misc_feature: HIJSMM301AIIAW.27.78.H01.1.454.light.4.raw

SEQ ID NO: 544122 - DNA, 490 bp, Homo sapiens; identical to SEQ ID NO: 535234
  misc_feature: HIJSMM301CI57J.17.21.B10.1.454.light.4.raw

SEQ ID NO: 544123 - DNA, 511 bp, Homo sapiens
  misc_feature: HIJSMM301EK1E9.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgtgtctgat

SEQ ID NO: 544124 - DNA, 441 bp, Homo sapiens
  misc_feature: HIJSMM301AHQHM.41.9.A09.1.454.light.4.raw
tctatactatcacgaccggtgctcgatttagcgagacgcgcagggtcctgggcccagtctgtcctgactcagccaccctcagcgtctgggacccccggcagacggtgaccatcccctgttctggaagcagttccaacatcggaagtaataatgtgaattggtaccggcaactcccaggaacggcccccaaactctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctccggtcactctgttcccaccctccctcatagtataga

SEQ ID NO: 544125 - DNA, 488 bp, Homo sapiens; identical to SEQ ID NO: 541295
  misc_feature: HIJSMM301D7F2K.9.59.F04.1.454.light.4.raw

SEQ ID NO: 544126 - DNA, 490 bp, Homo sapiens
  misc_feature: HIJSMM301B2COH.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 544127 - DNA, 454 bp, Homo sapiens; identical to SEQ ID NO: 534964
  misc_feature: HIJSMM301A3HGP.19.86.H09.1.454.light.4.raw

SEQ ID NO: 544128 - DNA, 500 bp, Homo sapiens
  misc_feature: HIJSMM301A7UM1.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccgaaggtggagatcaaacgaactgtggctgcaccatctgtcttcatcttccccg

SEQ ID NO: 544129 - DNA, 478 bp, Homo sapiens
  misc_feature: HIJSMM301DQXS0.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactagtggctgcaccat

SEQ ID NO: 544130 - DNA, 464 bp, Homo sapiens
  misc_feature: HIJSMM301DP2M0.17.28.C06.1.454.light.4.raw
cgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 544131 - DNA, 493 bp, Homo sapiens
  misc_feature: HIJSMM301BGFWR.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattttccccg

SEQ ID NO: 544132 - DNA, 503 bp, Homo sapiens
  misc_feature: HIJSMM301AOITK.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaaacgaactgtggctgcaccatctgtt

SEQ ID NO: 544133 - DNA, 476 bp, Homo sapiens; identical to SEQ ID NO: 538611
  misc_feature: HIJSMM301A7VGP.7.81.H04.1.454.light.4.raw

SEQ ID NO: 544134 - DNA, 486 bp, Homo sapiens
  misc_feature: HIJSMM301AMOBR.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcaccta

SEQ ID NO: 544135 - DNA, 491 bp, Homo sapiens; identical to SEQ ID NO: 543372
  misc_feature: HIJSMM301C3G8N.47.55.E11.1.454.light.4.raw

SEQ ID NO: 544136 - DNA, 464 bp, Homo sapiens
  misc_feature: HIJSMM301EXV2Q.43.71.G05.1.454.light.4.raw
tgtgagtagtcacgaccggtgctcgatttagtgtcgtcgcaagagagagggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccgccatctgaactactcaca

SEQ ID NO: 544137 - DNA, 491 bp, Homo sapiens; identical to SEQ ID NO: 535472
  misc_feature: HIJSMM301BSG8V.13.5.A05.1.454.light.4.raw

SEQ ID NO: 544138 - DNA, 420 bp, Homo sapiens; identical to SEQ ID NO: 540533
  misc_feature: HIJSMM301AJOPS.9.34.D01.1.454.light.4.raw

SEQ ID NO: 544139 - DNA, 485 bp, Homo sapiens
  misc_feature: HIJSMM301B6PG3.46.26.C04.1.454.light.4.raw
  modified_base (445)..(445): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgntccactttcggcggagggaccaaggtggagatcaaacgaa

SEQ ID NO: 544140 - DNA, 485 bp, Homo sapiens; identical to SEQ ID NO: 535749
  misc_feature: HIJSMM301DHMM4.46.35.D02.1.454.light.4.raw

SEQ ID NO: 544141 - DNA, 488 bp, Homo sapiens
  misc_feature: HIJSMM301AOOFU.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactaggacatcaaacgaactgtggctgcaccatctgtt

SEQ ID NO: 544142 - DNA, 494 bp, Homo sapiens; identical to SEQ ID NO: 536886
  misc_feature: HIJSMM301C5T8K.10.33.C11.1.454.light.4.raw

SEQ ID NO: 544143 - DNA, 513 bp, Homo sapiens
  misc_feature: HIJSMM301D46GP.51.28.C06.1.454.light.4.raw
cgatcgtatacacgaccggtgctcgatttagagctcacgtattgggtttgggggggtcgtcaggaggcagcactctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattggtgttcggcggagggaccaaactgaccgtcctaggtcagcccaacggctgccccctcggtcactcttcg

SEQ ID NO: 544144 - DNA, 510 bp, Homo sapiens; identical to SEQ ID NO: 542037
  misc_feature: HIJSMM301AY9K9.4.57.F02.1.454.light.4.raw

SEQ ID NO: 544145 - DNA, 524 bp, Homo sapiens
  misc_feature: HIJSMM301AUDFE.49.9.A09.1.454.light.4.raw
agtcgagagacacgaccggtgctcgatttagcgagacgcgcaggggagtctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctcggtcactctgttcccgccctcctctctctcg

SEQ ID NO: 544146 - DNA, 504 bp, Homo sapiens; identical to SEQ ID NO: 535128
  misc_feature: HIJSMM301AIA1O.19.85.H08.1.454.light.4.raw

SEQ ID NO: 544147 - DNA, 497 bp, Homo sapiens; identical to SEQ ID NO: 536371
  misc_feature: HIJSMM301CK58Q.16.78.H01.1.454.light.4.raw

SEQ ID NO: 544148 - DNA, 519 bp, Homo sapiens
  misc_feature: HIJSMM301EF8XR.41.87.H10.1.454.light.4.raw
tctatactatcacgaccggtgctcgatttagcagtactgcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccg

SEQ ID NO: 544149 - DNA, 489 bp, Homo sapiens; identical to SEQ ID NO: 535139
  misc_feature: HIJSMM301ER097.14.55.E11.1.454.light.4.raw

SEQ ID NO: 544150 - DNA, 470 bp, Homo sapiens
  misc_feature: HIJSMM301AXSX5.4.54.E10.1.454.light.4.raw
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagcacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgctaatttgaagattttgcaactttactactgtcaacagtagtttcagtatcccttggacttcgcaaggaccagtaggaatacaacgaac

SEQ ID NO: 544151 - DNA, 478 bp, Homo sapiens; identical to SEQ ID NO: 535129
  misc_feature: HIJSMM301DTPF5.11.11.A11.1.454.light.4.raw

SEQ ID NO: 544152 - DNA, 490 bp, Homo sapiens; identical to SEQ ID NO: 538999
  misc_feature: HIJSMM301EOUZ4.16.86.H09.1.454.light.4.raw

SEQ ID NO: 544153 - DNA, 497 bp, Homo sapiens
  misc_feature: HIJSMM301CIAFN.3.33.C11.1.454.light.4.raw
agacgcactccacgaccggtgctcgatttagagtgagctcgttgggtttgggggggtctcaggagtcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 544154 - DNA, 494 bp, Homo sapiens; identical to SEQ ID NO: 534992
  misc_feature: HIJSMM301AU2D1.9.1.A01.1.454.light.4.raw

SEQ ID NO: 544155 - DNA, 519 bp, Homo sapiens
  misc_feature: HIJSMM301DIWCW.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtcactctgttcccgccctcctccacg

SEQ ID NO: 544156 - DNA, 524 bp, Homo sapiens
  misc_feature: HIJSMM301AWFHT.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcgggacgggacaggctgaccgtcctaggtcagcccaaggctcgccccctcgtcactctcgttcccgccct

SEQ ID NO: 544157 - DNA, 484 bp, Homo sapiens; identical to SEQ ID NO: 535400
  misc_feature: HIJSMM301ER408.46.26.C04.1.454.light.4.raw

SEQ ID NO: 544158 - DNA, 492 bp, Homo sapiens
  misc_feature: HIJSMM301DGOZN.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggtccgacgggaccgacgggtggaaagtacaaacgaactagtggcgtcgcacca

SEQ ID NO: 544159 - DNA, 482 bp, Homo sapiens
  misc_feature: HIJSMM301CP8SS.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaactagtggctgcacca

SEQ ID NO: 544160 - DNA, 501 bp, Homo sapiens; identical to SEQ ID NO: 536142
  misc_feature: HIJSMM301CBI4J.15.1.A01.1.454.light.4.raw

SEQ ID NO: 544161 - DNA, 497 bp, Homo sapiens; identical to SEQ ID NO: 536376
  misc_feature: HIJSMM301ERV5H.22.9.A09.1.454.light.4.raw

SEQ ID NO: 544162 - DNA, 486 bp, Homo sapiens
  misc_feature: HIJSMM301C9HT2.4.1.A01.1.454.light.4.raw
agcactgtagcacgaccggtgctcgatttagacgtctcatcgagggggaactgctcagttaggacccagacggaaccatggaacgccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcaggtgggtctgggacaggagttcactctcaccatcagcagcctgcagtctgatgatgttgcagtttattactgtcatcaatatggtgaccggcccacgttcggccaagggccaaggtggaaatcaaacgaactgtggctgcaccatctgtcttcta

SEQ ID NO: 544163 - DNA, 504 bp, Homo sapiens; identical to SEQ ID NO: 540636
  misc_feature: HIJSMM301B1CU1.19.67.G01.1.454.light.4.raw

SEQ ID NO: 544164 - DNA, 485 bp, Homo sapiens; identical to SEQ ID NO: 536723
  misc_feature: HIJSMM301CZ0UW.5.40.D07.1.454.light.4.raw

SEQ ID NO: 544165 - DNA, 473 bp, Homo sapiens
  misc_feature: HIJSMM301AV5YP.5.12.B01.1.454.light.4.raw
  modified_base (453)..(453): a, c, t, g, unknown or other
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggnggagggaccaagctgaccgt

SEQ ID NO: 544166 - DNA, 485 bp, Homo sapiens; identical to SEQ ID NO: 536040
  misc_feature: HIJSMM301AJFQ6.15.1.A01.1.454.light.4.raw

SEQ ID NO: 544167 - DNA, 485 bp, Homo sapiens; identical to SEQ ID NO: 541885
  misc_feature: HIJSMM301CG6WK.48.54.E10.1.454.light.4.raw

SEQ ID NO: 544168 - DNA, 512 bp, Homo sapiens; identical to SEQ ID NO: 541402
  misc_feature: HIJSMM301AN1XZ.43.19.B08.1.454.light.4.raw

SEQ ID NO: 544169 - DNA, 486 bp, Homo sapiens; identical to SEQ ID NO: 535043
  misc_feature: HIJSMM301DHKUM.46.35.D02.1.454.light.4.raw

SEQ ID NO: 544170 - DNA, 487 bp, Homo sapiens; identical to SEQ ID NO: 538190
  misc_feature: HIJSMM301BREXZ.47.70.G04.1.454.light.4.raw

SEQ ID NO: 544171 - DNA, 489 bp, Homo sapiens; identical to SEQ ID NO: 535139
  misc_feature: HIJSMM301A5C56.14.55.E11.1.454.light.4.raw

SEQ ID NO: 544172 - DNA, 488 bp, Homo sapiens
  misc_feature: HIJSMM301EJ1OR.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgcccctcggtcact

SEQ ID NO: 544173 - DNA, 484 bp, Homo sapiens; identical to SEQ ID NO: 540581
  misc_feature: HIJSMM301ALGSJ.3.88.H11.1.454.light.4.raw

SEQ ID NO: 544174 - DNA, 499 bp, Homo sapiens
  misc_feature: HIJSMM301EIH0P.22.14.B03.1.454.light.4.raw
acatacgcgtcacgaccggtgctcgatttagtgtgagtagttccgcgggggagctacaacaggcaggcaggggcgagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccca

SEQ ID NO: 544175 - DNA, 488 bp, Homo sapiens; identical to SEQ ID NO: 536710
  misc_feature: HIJSMM301DRTFJ.21.55.E11.1.454.light.4.raw

SEQ ID NO: 544176 - DNA, 447 bp, Homo sapiens; identical to SEQ ID NO: 535201
  misc_feature: HIJSMM301DHUNZ.18.9.A09.1.454.light.4.raw

SEQ ID NO: 544177 - DNA, 518 bp, Homo sapiens
  misc_feature: HIJSMM301DEBN9.14.70.G04.1.454.light.4.raw
  modified_base (508)..(508): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccccagaccctggagcctcagttggaagcagccgatccagcctgcggagcctgtgggcaggtcagcccaaggccaaccccacngtcactctcg

SEQ ID NO: 544178 - DNA, 501 bp, Homo sapiens; identical to SEQ ID NO: 535509
  misc_feature: HIJSMM301C7B9G.15.56.F01.1.454.light.4.raw

SEQ ID NO: 544179 - DNA, 484 bp, Homo sapiens
  misc_feature: HIJSMM301A9NKC.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccc

SEQ ID NO: 544180 - DNA, 444 bp, Homo sapiens; identical to SEQ ID NO: 535594
  misc_feature: HIJSMM301BJTPA.9.9.A09.1.454.light.4.raw

SEQ ID NO: 544181 - DNA, 517 bp, Homo sapiens
  misc_feature: HIJSMM301BM38M.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccaaccccactgtcactctgttcccgccctcctcagtcgct

SEQ ID NO: 544182 - DNA, 484 bp, Homo sapiens; identical to SEQ ID NO: 537399
  misc_feature: HIJSMM301CJOVR.7.75.G09.1.454.light.4.raw

SEQ ID NO: 544183 - DNA, 497 bp, Homo sapiens; identical to SEQ ID NO: 536371
  misc_feature: HIJSMM301D1UW3.16.78.H01.1.454.light.4.raw

SEQ ID NO: 544184 - DNA, 483 bp, Homo sapiens
  misc_feature: HIJSMM301CFLDH.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctggaccaaatgtggatatcaaacgaaactgtggctgcaccatctgtctt

SEQ ID NO: 544185 - DNA, 501 bp, Homo sapiens; identical to SEQ ID NO: 535746
  misc_feature: HIJSMM301BYSJL.18.11.A11.1.454.light.4.raw

SEQ ID NO: 544186 - DNA, 486 bp, Homo sapiens; identical to SEQ ID NO: 535043
  misc_feature: HIJSMM301A80H7.46.35.D02.1.454.light.4.raw

SEQ ID NO: 544187 - DNA, 483 bp, Homo sapiens; identical to SEQ ID NO: 535413
  misc_feature: HIJSMM301EGECE.26.78.H01.1.454.light.4.raw

SEQ ID NO: 544188 - DNA, 491 bp, Homo sapiens; identical to SEQ ID NO: 537488
  misc_feature: HIJSMM301D9PTW.15.3.A03.1.454.light.4.raw

SEQ ID NO: 544189 - DNA, 494 bp, Homo sapiens; identical to SEQ ID NO: 535497
  misc_feature: HIJSMM301D8F34.43.72.G06.1.454.light.4.raw

SEQ ID NO: 544190 - DNA, 488 bp, Homo sapiens
  misc_feature: HIJSMM301BMQTK.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacgacgactggagattaaacgaaactgtggctgcaccatctgtt

SEQ ID NO: 544191 - DNA, 488 bp, Homo sapiens; identical to SEQ ID NO: 542699
  misc_feature: HIJSMM301ANQ3X.12.51.E07.1.454.light.4.raw

SEQ ID NO: 544192 - DNA, 485 bp, Homo sapiens; identical to SEQ ID NO: 535652
  misc_feature: HIJSMM301C1Y8C.19.71.G05.1.454.light.4.raw

SEQ ID NO: 544193 - DNA, 506 bp, Homo sapiens
  misc_feature: HIJSMM301C9QWV.8.21.B10.1.454.light.4.raw
ctcgcgtgtccacgaccggtgctcgatttagtgtcgtcgcaggagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgtcggtcaaggaccgaaggtaggagatcaaacgaaactgtggctgcaccatctgtcttctatcttcccgccat

SEQ ID NO: 544194 - DNA, 487 bp, Homo sapiens; identical to SEQ ID NO: 536206
  misc_feature: HIJSMM301DK6BV.47.38.D05.1.454.light.4.raw

SEQ ID NO: 544195 - DNA, 502 bp, Homo sapiens
  misc_feature: HIJSMM301CAMDA.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctggggacagagttcactctcaccatcagcagcctgcagtctgaagattttgcagtttattattgtcagcagtataataactggcctccgtggacgttcggccaagggaccgaaggtggaaatcaaacgaactagtggctgcaccatctgtcttcta

SEQ ID NO: 544196 - DNA, 489 bp, Homo sapiens; identical to SEQ ID NO: 536013
  misc_feature: HIJSMM301A0IE0.26.23.C01.1.454.light.4.raw

SEQ ID NO: 544197 - DNA, 493 bp, Homo sapiens; identical to SEQ ID NO: 536471
  misc_feature: HIJSMM301AG6RD.3.71.G05.1.454.light.4.raw

SEQ ID NO: 544198 - DNA, 507 bp, Homo sapiens
  misc_feature: HIJSMM301B0KHH.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 544199 - DNA, 490 bp, Homo sapiens
  misc_feature: HIJSMM301AGAQO.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaactttattattgtcaacagggtaacagtttcccgctcaccttcggcggagggaccaaggtggagatgaaaagaactgtggctgcaccat

SEQ ID NO: 544200 - DNA, 490 bp, Homo sapiens; identical to SEQ ID NO: 535420
  misc_feature: HIJSMM301DV6A2.3.72.G06.1.454.light.4.raw

SEQ ID NO: 544201 - DNA, 491 bp, Homo sapiens
  misc_feature: HIJSMM301DWSM0.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcaccatct

SEQ ID NO: 544202 - DNA, 479 bp, Homo sapiens; identical to SEQ ID NO: 535118
  misc_feature: HIJSMM301CEC7C.13.59.F04.1.454.light.4.raw

SEQ ID NO: 544203 - DNA, 354 bp, Homo sapiens; identical to SEQ ID NO: 535026
  misc_feature: HIJSMM301AV2LA.19.22.B11.1.454.light.4.raw

SEQ ID NO: 544204 - DNA, 490 bp, Homo sapiens; identical to SEQ ID NO: 543909
  misc_feature: HIJSMM301DJYW2.14.55.E11.1.454.light.4.raw

SEQ ID NO: 544205 - DNA, 520 bp, Homo sapiens; identical to SEQ ID NO: 535773
  misc_feature: HIJSMM301D7HK8.41.19.B08.1.454.light.4.raw

SEQ ID NO: 544206 - DNA, 502 bp, Homo sapiens
  misc_feature: HIJSMM301C2KSR.18.59.F04.1.454.light.4.raw
  modified_base (302)..(302): a, c, t, g, unknown or other
tacgagtatgcacgaccggtgctcgatttagtacacacacttagggattggggggggtctcaggaggcagcgctctcgggacgtctccaccatggcctgggctctgcctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccc

SEQ ID NO: 544207 - DNA, 490 bp, Homo sapiens; identical to SEQ ID NO: 535234
  misc_feature: HIJSMM301BUP3M.17.21.B10.1.454.light.4.raw

SEQ ID NO: 544208 - DNA, 498 bp, Homo sapiens
  misc_feature: HIJSMM301ARJZ0.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggaggatcagacgaactgtggcgtgcaccatctgtcttcatcttcccgt

SEQ ID NO: 544209 - DNA, 498 bp, Homo sapiens
  misc_feature: HIJSMM301CH8E4.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctcgccccctcggtcctacc

SEQ ID NO: 544210 - DNA, 495 bp, Homo sapiens
  misc_feature: HIJSMM301DA2TZ.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 544211 - DNA, 504 bp, Homo sapiens
  misc_feature: HIJSMM301BZYIZ.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtctaggtcagcccaaggctgccccctggt

SEQ ID NO: 544212 - DNA, 501 bp, Homo sapiens
  misc_feature: HIJSMM301D0457.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcattt

SEQ ID NO: 544213 - DNA, 511 bp, Homo sapiens
  misc_feature: HIJSMM301CT8VA.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagatttgcgacttactattgtcaacagagttaccttctcccccggacgttcggtccaacggaccgaacggtaggaaagtacaagacgaacgtagtggcgtgcaccatctgtcttctatcttcccgt

SEQ ID NO: 544214 - DNA, 485 bp, Homo sapiens; identical to SEQ ID NO: 536576
  misc_feature: HIJSMM301DHAMO.46.35.D02.1.454.light.4.raw

SEQ ID NO: 544215 - DNA, 487 bp, Homo sapiens; identical to SEQ ID NO: 539157
  misc_feature: HIJSMM301AISAX.26.37.D04.1.454.light.4.raw

SEQ ID NO: 544216 - DNA, 496 bp, Homo sapiens
  misc_feature: HIJSMM301BY775.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgccatctgac

SEQ ID NO: 544217 - DNA, 519 bp, Homo sapiens
  misc_feature: HIJSMM301BTJD4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccgcct

SEQ ID NO: 544218 - DNA, 494 bp, Homo sapiens; identical to SEQ ID NO: 534994
  misc_feature: HIJSMM301C4GM9.27.78.H01.1.454.light.4.raw

SEQ ID NO: 544219 - DNA, 447 bp, Homo sapiens; identical to SEQ ID NO: 541817
  misc_feature: HIJSMM301A33Y5.18.9.A09.1.454.light.4.raw

SEQ ID NO: 544220 - DNA, 503 bp, Homo sapiens; identical to SEQ ID NO: 537216
  misc_feature: HIJSMM301CUEHM.3.70.G04.1.454.light.4.raw

SEQ ID NO: 544221 - DNA, 496 bp, Homo sapiens; identical to SEQ ID NO: 535109
  misc_feature: HIJSMM301CZ094.16.78.H01.1.454.light.4.raw

SEQ ID NO: 544222 - DNA, 441 bp, Homo sapiens; identical to SEQ ID NO: 535074
  misc_feature: HIJSMM301DPBVB.11.3.A03.1.454.light.4.raw

SEQ ID NO: 544223 - DNA, 487 bp, Homo sapiens
  misc_feature: HIJSMM301EE825.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgaac

SEQ ID NO: 544224 - DNA, 444 bp, Homo sapiens; identical to SEQ ID NO: 534993
  misc_feature: HIJSMM301DX7XY.5.9.A09.1.454.light.4.raw

SEQ ID NO: 544225 - DNA, 483 bp, Homo sapiens; identical to SEQ ID NO: 535317
  misc_feature: HIJSMM301A72PA.4.1.A01.1.454.light.4.raw

SEQ ID NO: 544226 - DNA, 527 bp, Homo sapiens
  misc_feature: HIJSMM301B5OEN.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgtaccgtcctaggtcagcccaacggctgccccctccggtcactctgttccaccctcctccactact

SEQ ID NO: 544227 - DNA, 502 bp, Homo sapiens
  misc_feature: HIJSMM301AYVFG.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactg

SEQ ID NO: 544228 - DNA, 454 bp, Homo sapiens; identical to SEQ ID NO: 534964
  misc_feature: HIJSMM301CUZON.19.86.H09.1.454.light.4.raw

SEQ ID NO: 544229 - DNA, 491 bp, Homo sapiens; identical to SEQ ID NO: 535176
  misc_feature: HIJSMM301AE8FT.13.39.D06.1.454.light.4.raw

SEQ ID NO: 544230 - DNA, 445 bp, Homo sapiens; identical to SEQ ID NO: 537719
  misc_feature: HIJSMM301AWAQJ.47.85.H08.1.454.light.4.raw

SEQ ID NO: 544231 - DNA, 495 bp, Homo sapiens; identical to SEQ ID NO: 541828
  misc_feature: HIJSMM301CN66C.19.71.G05.1.454.light.4.raw

SEQ ID NO: 544232 - DNA, 494 bp, Homo sapiens; identical to SEQ ID NO: 534994
  misc_feature: HIJSMM301CWR4S.27.78.H01.1.454.light.4.raw

SEQ ID NO: 544233 - DNA, 492 bp, Homo sapiens
  misc_feature: HIJSMM301B4V0U.4.40.D07.1.454.light.4.raw
agcactgtagcacgaccggtgctcgatttagtgatagagcgtaacaacagagggggctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggcgcgcgttttcggcgggggaccgaagtggacatcaaacgaaacgtgtggcgtgcaccactctgtctt

SEQ ID NO: 544234 - DNA, 448 bp, Homo sapiens
  misc_feature: HIJSMM301BUFHP.18.9.A09.1.454.light.4.raw
tacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 544235 - DNA, 510 bp, Homo sapiens
  misc_feature: HIJSMM301AWE9P.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcacttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagccaaggctgccccctcggtcactctgttcccaccct

SEQ ID NO: 544236 - DNA, 492 bp, Homo sapiens
  misc_feature: HIJSMM301DJ7T3.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcaccatctgt

SEQ ID NO: 544237 - DNA, 483 bp, Homo sapiens
  misc_feature: HIJSMM301BT92C.17.25.C03.1.454.light.4.raw
cgtagactagcacgaccggtgctcgatttagtagtgtagatttgggtttgggagtcagtctcagtcaggacacagcatggacatgagggccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatct

SEQ ID NO: 544238 - DNA, 489 bp, Homo sapiens
  misc_feature: HIJSMM301A3K7J.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctccctcatctatgctgcatccatcgagggccactggcatcccaggcagattcagtggcagtgggtctgggacagacttcactctcaccatcagcagactggagcctgaagattttgcagtctattactgtcagcagtatggtcacgtcccaagtaactttcggcgagggaccaagctggagatacaaacgaactgtggctgcaccat

SEQ ID NO: 544239 - DNA, 492 bp, Homo sapiens
  misc_feature: HIJSMM301E0TGU.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaa

SEQ ID NO: 544240 - DNA, 444 bp, Homo sapiens
  misc_feature: HIJSMM301ELM3G.9.9.A09.1.454.light.4.raw
  modified_base (426)..(426): a, c, t, g, unknown or other
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccnccctcctcagacgtatca

SEQ ID NO: 544241 - DNA, 460 bp, Homo sapiens; identical to SEQ ID NO: 539553
  misc_feature: HIJSMM301EJ6XN.11.86.H09.1.454.light.4.raw

SEQ ID NO: 544242 - DNA, 514 bp, Homo sapiens
  misc_feature: HIJSMM301DV0ND.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccct

SEQ ID NO: 544243 - DNA, 494 bp, Homo sapiens; identical to SEQ ID NO: 534992
  misc_feature: HIJSMM301CNA9Z.9.1.A01.1.454.light.4.raw

SEQ ID NO: 544244 - DNA, 383 bp, Homo sapiens
  misc_feature: HIJSMM301DGC7R.41.53.E09.1.454.light.4.raw
tctatactatcacgaccggtgctcgatttagagagagtgtgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 544245 - DNA, 488 bp, Homo sapiens; identical to SEQ ID NO: 537673
  misc_feature: HIJSMM301CJWI9.12.31.C09.1.454.light.4.raw

SEQ ID NO: 544246 - DNA, 448 bp, Homo sapiens
  misc_feature: HIJSMM301DUH7D.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 544247 - DNA, 492 bp, Homo sapiens
  misc_feature: HIJSMM301EA7G0.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaagtaggacatcaagcgaactagtggctgcaccatctgtt

SEQ ID NO: 544248 - DNA, 483 bp, Homo sapiens; identical to SEQ ID NO: 535777
  misc_feature: HIJSMM301CU1YI.10.1.A01.1.454.light.4.raw

SEQ ID NO: 544249 - DNA, 494 bp, Homo sapiens; identical to SEQ ID NO: 538230
  misc_feature: HIJSMM301AOKCT.11.71.G05.1.454.light.4.raw

SEQ ID NO: 544250 - DNA, 486 bp, Homo sapiens; identical to SEQ ID NO: 535043
  misc_feature: HIJSMM301ECQRE.46.35.D02.1.454.light.4.raw

SEQ ID NO: 544251 - DNA, 493 bp, Homo sapiens
  misc_feature: HIJSMM301C35ZT.21.27.C05.1.454.light.4.raw
tcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggtcactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaacgaactgtggctgcaccatctgtctt

SEQ ID NO: 544252 - DNA, 513 bp, Homo sapiens; identical to SEQ ID NO: 540462
  misc_feature: HIJSMM301BIRS5.47.85.H08.1.454.light.4.raw

SEQ ID NO: 544253 - DNA, 465 bp, Homo sapiens; identical to SEQ ID NO: 540896
  misc_feature: HIJSMM301AHB76.11.70.G04.1.454.light.4.raw

SEQ ID NO: 544254 - DNA, 485 bp, Homo sapiens
  misc_feature: HIJSMM301CS1AU.52.33.C11.1.454.light.4.raw
cgcagtacgacacgaccggtgctcgatttagagtgagctcgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctcg

SEQ ID NO: 544255 - DNA, 495 bp, Homo sapiens; identical to SEQ ID NO: 535007
  misc_feature: HIJSMM301CIV1J.22.5.A05.1.454.light.4.raw

SEQ ID NO: 544256 - DNA, 476 bp, Homo sapiens; identical to SEQ ID NO: 536632
  misc_feature: HIJSMM301AYR7B.52.1.A01.1.454.light.4.raw

SEQ ID NO: 544257 - DNA, 487 bp, Homo sapiens; identical to SEQ ID NO: 537220
  misc_feature: HIJSMM301AGHFE.16.53.E09.1.454.light.4.raw

SEQ ID NO: 544258 - DNA, 502 bp, Homo sapiens
  misc_feature: HIJSMM301CFQ5O.40.71.G05.1.454.light.4.raw
tctagcgactcacgaccggtgctcgatttagtgtcgtcgcaagagagaggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttattattgcggaacatgggatagcggcctgagtgatgagtggatgttcggcggcgggaccaaactgaccgtcctaggtcagaccccg

SEQ ID NO: 544259 - DNA, 481 bp, Homo sapiens
  misc_feature: HIJSMM301CNWQO.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcacc

SEQ ID NO: 544260 - DNA, 484 bp, Homo sapiens; identical to SEQ ID NO: 535400
  misc_feature: HIJSMM301AR2TN.46.26.C04.1.454.light.4.raw

SEQ ID NO: 544261 - DNA, 497 bp, Homo sapiens
  misc_feature: HIJSMM301CBJ1P.48.31.C09.1.454.light.4.raw
agtatacatacacgaccggtgctcgatttagacgtctcatcaaggaaggaaggggagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacttcggccaagggaccaaggtggaagtcagacgaactgtggctgcaccatctgtcttcatcttcccg

SEQ ID NO: 544262 - DNA, 497 bp, Homo sapiens
  misc_feature: HIJSMM301CVWHU.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggtaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactgt

SEQ ID NO: 544263 - DNA, 494 bp, Homo sapiens; identical to SEQ ID NO: 535629
  misc_feature: HIJSMM301DU0N0.4.27.C05.1.454.light.4.raw

SEQ ID NO: 544264 - DNA, 507 bp, Homo sapiens
  misc_feature: HIJSMM301DUHUH.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccta

SEQ ID NO: 544265 - DNA, 485 bp, Homo sapiens; identical to SEQ ID NO: 538954
  misc_feature: HIJSMM301ELGFL.3.55.E11.1.454.light.4.raw

SEQ ID NO: 544266 - DNA, 489 bp, Homo sapiens
  misc_feature: HIJSMM301A7QCF.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccagtcaaggttcagcggcagtggatctgggacagatttcactctcaccatcagcagcctgcagcctgaagattttgctaacttactattgtcaacaggctaacagtttccctccgtacctcgtccacggacgacgacgtggagagtaacgtaaactacgtaggcgt

SEQ ID NO: 544267 - DNA, 504 bp, Homo sapiens
  misc_feature: HIJSMM301AMS2L.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtcta

SEQ ID NO: 544268 - DNA, 517 bp, Homo sapiens
  misc_feature: HIJSMM301DO9YE.40.27.C05.1.454.light.4.raw
tctagcgactcacgaccggtgctcgatttagacgcgatcgaagggtttggggcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggcgtgaccgtcctaggtcagcccaaggctgccccctcggtcact

SEQ ID NO: 544269 - DNA, 483 bp, Homo sapiens
  misc_feature: HIJSMM301A8JTI.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctctcaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaa

SEQ ID NO: 544270 - DNA, 488 bp, Homo sapiens
  misc_feature: HIJSMM301EUBVH.48.29.C07.1.454.light.4.raw
agtatacatacacgaccggtgctcgatttagagtgctacgaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 544271 - DNA, 493 bp, Homo sapiens; identical to SEQ ID NO: 535745
  misc_feature: HIJSMM301A5612.47.78.H01.1.454.light.4.raw

SEQ ID NO: 544272 - DNA, 486 bp, Homo sapiens; identical to SEQ ID NO: 535385
  misc_feature: HIJSMM301EZH5P.19.71.G05.1.454.light.4.raw

SEQ ID NO: 544273 - DNA, 484 bp, Homo sapiens
  misc_feature: HIJSMM301C05HD.53.32.C10.1.454.light.4.raw
cgcgtatacacacgaccggtgctcgatttagtatagacatcaacacacaaaggggctgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacaggccagtcccctgtgttggtcatttatcaagatgacaagcggccctcagggatccctgagcggttctctggctccaactctgggaacacagccactctgaccatcagcgggacccaggctatggatgaggctgactattactgtcaggcgtgggacagcagcactatggtgttcggcggagggaccaagctgaccgtcctaggtcagcccaaggctcg

SEQ ID NO: 544274 - DNA, 472 bp, Homo sapiens
  misc_feature: HIJSMM301EI4G8.3.82.H05.1.454.light.4.raw
agacgcactccacgaccggtgctcgatttagtcgagctctctcgcgggggcaggagtcagacccacgtcaggacacagcatggacatgagggtccccgcctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccgaaggtggagatcaaacgaa

SEQ ID NO: 544275 - DNA, 502 bp, Homo sapiens
  misc_feature: HIJSMM301DPS74.41.57.F02.1.454.light.4.raw
tctatactatcacgaccggtgctcgatttagctcgatatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggaggaccaagctgaccgtcctaggtcagcccaaggctgccccctcggt

SEQ ID NO: 544276 - DNA, 445 bp, Homo sapiens
  misc_feature: HIJSMM301ENHPV.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctgagtcagcccaaggctgccccctcggtcactctgttccccgccctcctccgtgtctgat

SEQ ID NO: 544277 - DNA, 497 bp, Homo sapiens
  misc_feature: HIJSMM301BYQDQ.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctctttagtcatgtatcgggatagaaagcggccctcagggatccctgagcgcttctctggatccaactctgggaacacagccactctgaccatcagcgggacccaactttagatgaggccgactatttctgtcacacgtgggacatgggcactgcgatcttcggcggagggaccaagctgaccgtcctgggtcagcccaaggctcgcccccgtcggtcacttcc

SEQ ID NO: 544278 - DNA, 485 bp, Homo sapiens; identical to SEQ ID NO: 535501
  misc_feature: HIJSMM301B0NC7.3.10.A10.1.454.light.4.raw

SEQ ID NO: 544279 - DNA, 489 bp, Homo sapiens
  misc_feature: HIJSMM301C8XGR.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaaggacacgactggagattaaacgaactgtggctgcaccatctgtcttcat

SEQ ID NO: 544280 - DNA, 489 bp, Homo sapiens
  misc_feature: HIJSMM301ATQ2N.4.27.C05.1.454.light.4.raw
agcactgtagcacgaccggtgctcgatttagacgcgatcgaagggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgt

SEQ ID NO: 544281 - DNA, 508 bp, Homo sapiens; identical to SEQ ID NO: 541919
  misc_feature: HIJSMM301ES2EN.19.72.G06.1.454.light.4.raw

SEQ ID NO: 544282 - DNA, 500 bp, Homo sapiens; identical to SEQ ID NO: 535310
  misc_feature: HIJSMM301C6T3P.47.66.F11.1.454.light.4.raw

SEQ ID NO: 544283 - DNA, 493 bp, Homo sapiens; identical to SEQ ID NO: 537281
  misc_feature: HIJSMM301BSPBA.9.1.A01.1.454.light.4.raw

SEQ ID NO: 544284 - DNA, 490 bp, Homo sapiens; identical to SEQ ID NO: 535936
  misc_feature: HIJSMM301BWDIH.16.68.G02.1.454.light.4.raw

SEQ ID NO: 544285 - DNA, 473 bp, Homo sapiens
  misc_feature: HIJSMM301C2T88.51.13.B02.1.454.light.4.raw
cgatcgtatacacgaccggtgctcgatttagtctagcgacttccgcggggcgggggcacttctccctctaacactctccctgctcagctcctggggctcctgctgctctggctctcaggtgccagatgtgacatccagatgtcccagtctccatcctccctgtctgcatctgttggagacagagtcaccatcacttgccagacaagtcacgacgttcgcagatatttaagctggtatcagcagagaccagggaaagcccctaaactcctgatatacgatgcatcccatttgggagcaggggtcccatcaagattcagtggaagtggatctgggacacattttactttcaccatcagtagcctgcagcctgaagatgtcgccacatattactgtcaacagcatgataatctctccaccttcggccaagggacacgactggaaattaaacgagctgtggctgcaccatctgtctt

SEQ ID NO: 544286 - DNA, 496 bp, Homo sapiens; identical to SEQ ID NO: 535109
  misc_feature: HIJSMM301B7BWQ.16.78.H01.1.454.light.4.raw

SEQ ID NO: 544287 - DNA, 475 bp, Homo sapiens; identical to SEQ ID NO: 537850
  misc_feature: HIJSMM301EKOFK.13.76.G10.1.454.light.4.raw

SEQ ID NO: 544288 - DNA, 495 bp, Homo sapiens; identical to SEQ ID NO: 535143
  misc_feature: HIJSMM301EBUY0.51.29.C07.1.454.light.4.raw

SEQ ID NO: 544289 - DNA, 444 bp, Homo sapiens; identical to SEQ ID NO: 535856
  misc_feature: HIJSMM301DCSJ2.9.9.A09.1.454.light.4.raw

SEQ ID NO: 544290 - DNA, 500 bp, Homo sapiens
  misc_feature: HIJSMM301DNTRI.48.31.C09.1.454.light.4.raw
agtatacatacacgaccggtgctcgatttagacgtctcatcaaggaaggaaggggcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcggctcaccatcagcagtctacaacctgaagattttgcaacctacttctgtcaccaggcttacaattcccctccgacgttcggccaagggaccaaggtggaagtcagacgaactgtggctgcaccatctgtcttcatcttccccg

SEQ ID NO: 544291 - DNA, 494 bp, Homo sapiens
  misc_feature: HIJSMM301EK6CT.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctctcagacgttcggccaagggaccaaggtggaaatcaaacgaactgtggctgcacc

SEQ ID NO: 544292 - DNA, 499 bp, Homo sapiens
  misc_feature: HIJSMM301B59AI.48.33.C11.1.454.light.4.raw
agtatacatacacgaccggtgctcgatttagagtgagctcgttgggtttgggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactgtggctgcacc

SEQ ID NO: 544293 - DNA, 485 bp, Homo sapiens
  misc_feature: HIJSMM301DJF2L.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaaacgaactgtggctgcacc

SEQ ID NO: 544294 - DNA, 488 bp, Homo sapiens; identical to SEQ ID NO: 535081
  misc_feature: HIJSMM301AHMDH.26.23.C01.1.454.light.4.raw

SEQ ID NO: 544295 - DNA, 496 bp, Homo sapiens; identical to SEQ ID NO: 537513
  misc_feature: HIJSMM301B1QUX.12.87.H10.1.454.light.4.raw

SEQ ID NO: 544296 - DNA, 441 bp, Homo sapiens; identical to SEQ ID NO: 534971
  misc_feature: HIJSMM301ERB8K.11.3.A03.1.454.light.4.raw

SEQ ID NO: 544297 - DNA, 502 bp, Homo sapiens
  misc_feature: HIJSMM301CD6YY.9.12.B01.1.454.light.4.raw
  modified_base (481)..(481): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcgccgaggaccgaaggtggaaagtacaaacgaactgtgctgcnccatctgtcttcatcttcccg

SEQ ID NO: 544298 - DNA, 486 bp, Homo sapiens
  misc_feature: HIJSMM301CIOPC.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccc

SEQ ID NO: 544299 - DNA, 504 bp, Homo sapiens; identical to SEQ ID NO: 535561
  misc_feature: HIJSMM301EWB7L.4.57.F02.1.454.light.4.raw

SEQ ID NO: 544300 - DNA, 488 bp, Homo sapiens
  misc_feature: HIJSMM301ATAI2.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagttttcggcggagggaccaaggtggagatcaaacgaactgtggctgcaccatctgt

SEQ ID NO: 544301 - DNA, 441 bp, Homo sapiens; identical to SEQ ID NO: 534971
  misc_feature: HIJSMM301DK8PM.11.3.A03.1.454.light.4.raw

SEQ ID NO: 544302 - DNA, 503 bp, Homo sapiens; identical to SEQ ID NO: 538884
  misc_feature: HIJSMM301AZORW.27.78.H01.1.454.light.4.raw

SEQ ID NO: 544303 - DNA, 501 bp, Homo sapiens; identical to SEQ ID NO: 535873
  misc_feature: HIJSMM301AP7CP.17.27.C05.1.454.light.4.raw

SEQ ID NO: 544304 - DNA, 480 bp, Homo sapiens
  misc_feature: HIJSMM301DON7X.10.33.C11.1.454.light.4.raw
  modified_base (410)..(410): a, c, t, g, unknown or other
  modified_base (424)..(424): a, c, t, g, unknown or other
  modified_base (470)..(470): a, c, t, g, unknown or other
  modified_base (478)..(478): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaaactcctgatctacgatgcatcgaacttggaaacaggggtcccatcaaggttcagtggaggtggatctgggacagatttactctcggcatccgcagcctgcaagcctgaagattttgcgacatattactgtnaacagtatgaaaangtccgctcacttgcggggcggacggaggagtagtaacgaataatgntgcacacnct

SEQ ID NO: 544305 - DNA, 489 bp, Homo sapiens; identical to SEQ ID NO: 535250
  misc_feature: HIJSMM301BGW5T.14.55.E11.1.454.light.4.raw

SEQ ID NO: 544306 - DNA, 501 bp, Homo sapiens
  misc_feature: HIJSMM301AI89U.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgtagtctgaagattttgcagtttattactgtcagcagtatgatacctggcctccgtacacttttggccgggggaccgaagctggaaatcaagcgaactgtggctgcaccatctgtcttcatcttccccg

SEQ ID NO: 544307 - DNA, 493 bp, Homo sapiens; identical to SEQ ID NO: 535745
  misc_feature: HIJSMM301AZEYC.47.78.H01.1.454.light.4.raw

SEQ ID NO: 544308 - DNA, 389 bp, Homo sapiens
  misc_feature: HIJSMM301EGIFQ.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaatggcccccaaactcctcatctataggaataatcagcggccctcaggggtccctgaccgattctctggctccaattctggcacctcagcctccctggccatcagtgggctccggtccgaggatgaggctgattattactgtgcagcatgtgatgacggctgagtggtccggtgttcggcggaggaccaggctgaccgtcctaggtcagcccaaggctcgccccctcggtcactctcgttcccgccctcctccgagcgacga

SEQ ID NO: 544309 - DNA, 490 bp, Homo sapiens; identical to SEQ ID NO: 537951
  misc_feature: HIJSMM301B4GA8.19.57.F02.1.454.light.4.raw

SEQ ID NO: 544310 - DNA, 497 bp, Homo sapiens; identical to SEQ ID NO: 535286
  misc_feature: HIJSMM301EOH7T.18.59.F04.1.454.light.4.raw

SEQ ID NO: 544311 - DNA, 502 bp, Homo sapiens
  misc_feature: HIJSMM301C7EPS.48.23.C01.1.454.light.4.raw
agtatacatacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtcactctcg

SEQ ID NO: 544312 - DNA, 460 bp, Homo sapiens; identical to SEQ ID NO: 537107
  misc_feature: HIJSMM301CVW11.22.28.C06.1.454.light.4.raw

SEQ ID NO: 544313 - DNA, 512 bp, Homo sapiens
  misc_feature: HIJSMM301AT2A8.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcgcggagggaccaagctgaccgtcctaggtcagcccaaggctgccccctcggtcactctgttccca

SEQ ID NO: 544314 - DNA, 502 bp, Homo sapiens; identical to SEQ ID NO: 541971
  misc_feature: HIJSMM301BISZL.4.39.D06.1.454.light.4.raw

SEQ ID NO: 544315 - DNA, 518 bp, Homo sapiens
  misc_feature: HIJSMM301A0NEN.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtgggcaggtcagcccaaggctgccccctcggtccactctgttcccaccctcctccacg

SEQ ID NO: 544316 - DNA, 493 bp, Homo sapiens
  misc_feature: HIJSMM301BNQS9.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcattttcccg

SEQ ID NO: 544317 - DNA, 490 bp, Homo sapiens
  misc_feature: HIJSMM301EO7VR.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 544318 - DNA, 441 bp, Homo sapiens; identical to SEQ ID NO: 535074
  misc_feature: HIJSMM301DJUJV.11.3.A03.1.454.light.4.raw

SEQ ID NO: 544319 - DNA, 484 bp, Homo sapiens; identical to SEQ ID NO: 539370
  misc_feature: HIJSMM301EEOTX.22.73.G07.1.454.light.4.raw

SEQ ID NO: 544320 - DNA, 445 bp, Homo sapiens
  misc_feature: HIJSMM301C6838.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggacgaggctgattattactgcagctcatatacaagcaccagcactctctatgtcttcggaactgggaccaaggtcaccgtcctaggtcagcccaaggcccaaccccactgtcactctgttcccaccctcctccatactcgta

SEQ ID NO: 544321 - DNA, 475 bp, Homo sapiens; identical to SEQ ID NO: 539478
  misc_feature: HIJSMM301B4CFQ.7.81.H04.1.454.light.4.raw

SEQ ID NO: 544322 - DNA, 463 bp, Homo sapiens; identical to SEQ ID NO: 535062
  misc_feature: HIJSMM301DLMXE.11.73.G07.1.454.light.4.raw

SEQ ID NO: 544323 - DNA, 404 bp, Homo sapiens; identical to SEQ ID NO: 535530
  misc_feature: HIJSMM301DG95K.4.35.D02.1.454.light.4.raw

SEQ ID NO: 544324 - DNA, 501 bp, Homo sapiens
  misc_feature: HIJSMM301CGTBG.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtaact

SEQ ID NO: 544325 - DNA, 508 bp, Homo sapiens
  misc_feature: HIJSMM301DZUY9.5.58.F03.1.454.light.4.raw
  modified_base (412)..(412): a, c, t, g, unknown or other
atcagacacgcacgaccggtgctcgatttagtctgatcgaggaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaactttggttatcagggcaataagcggccctcaggggttctaatcgcttctctggctccaagtctggcaacacggccgccctgacaatctctgggctccaggctgacgacgaggctgattttacngctgctcatatgcaggtgatcacacttttatgttcgggactgggaccaaggtcaccgtcctaggtcagcccaaggccaacccactgtcactcttcg

SEQ ID NO: 544326 - DNA, 504 bp, Homo sapiens; identical to SEQ ID NO: 540538
  misc_feature: HIJSMM301C59R1.7.71.G05.1.454.light.4.raw

SEQ ID NO: 544327 - DNA, 486 bp, Homo sapiens; identical to SEQ ID NO: 535385
  misc_feature: HIJSMM301B3QK6.19.71.G05.1.454.light.4.raw

SEQ ID NO: 544328 - DNA, 305 bp, Homo sapiens
  misc_feature: HIJSMM301A4OA1.49.19.B08.1.454.light.4.raw
agtcgagagacacgaccggtgctcgatttagtgagtcagtaagggcccccagactcctcattcatgacaatagcaagcgagtcccagagattcctgaccgattctctggctccaagtctggcacctcagccaccctggccatcaccggactccagactggggacgaggccgattattactgcggaacatgggattccagcctgagtggtgtcagggtgttcggcggagggaccaagctgaccgtcctaggtcagcccaaggctggcccctcggtcactctgttcccaccctcctctctctcgact

SEQ ID NO: 544329 - DNA, 489 bp, Homo sapiens
  misc_feature: HIJSMM301AH7L1.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccgaaggtggagatcaaacgaa

SEQ ID NO: 544330 - DNA, 441 bp, Homo sapiens; identical to SEQ ID NO: 534971
  misc_feature: HIJSMM301EU7EH.11.3.A03.1.454.light.4.raw

SEQ ID NO: 544331 - DNA, 486 bp, Homo sapiens; identical to SEQ ID NO: 537238
  misc_feature: HIJSMM301BKV1Z.19.71.G05.1.454.light.4.raw

SEQ ID NO: 544332 - DNA, 501 bp, Homo sapiens
  misc_feature: HIJSMM301AKGJ3.22.57.F02.1.454.light.4.raw
acatacgcgtcacgaccggtgctcgatttagctcgatatagttgggtttggggagtcagacccagtcaggacacagcatggacattagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatcttccccg

SEQ ID NO: 544333 - DNA, 521 bp, Homo sapiens; identical to SEQ ID NO: 538715
  misc_feature: HIJSMM301DXZTF.27.23.C01.1.454.light.4.raw

SEQ ID NO: 544334 - DNA, 491 bp, Homo sapiens
  misc_feature: HIJSMM301ARTEN.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgttcagcaatattatacttctcttccgatcacttttggccaggggaccaggctggaggtcagacgaactacgtggcgtcg

SEQ ID NO: 544335 - DNA, 493 bp, Homo sapiens
  misc_feature: HIJSMM301BK737.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 544336 - DNA, 486 bp, Homo sapiens
  misc_feature: HIJSMM301D1719.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacaccccctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgaa

SEQ ID NO: 544337 - DNA, 504 bp, Homo sapiens
  misc_feature: HIJSMM301EBUUA.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgccaaggaccaaggtggaagtcaagcgaactgtggctgcaccatctgtcttcatcttccgcc

SEQ ID NO: 544338 - DNA, 489 bp, Homo sapiens; identical to SEQ ID NO: 535139
  misc_feature: HIJSMM301CDF09.14.55.E11.1.454.light.4.raw

SEQ ID NO: 544339 - DNA, 503 bp, Homo sapiens
  misc_feature: HIJSMM301BEA5W.48.62.F07.1.454.light.4.raw
agtatacatacacgaccggtgctcgatttagtagtcgcataaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaacgggacacgactggagattaaacgaactgtggctgcaccatctgtcttcatcttcccg

SEQ ID NO: 544340 - DNA, 497 bp, Homo sapiens
  misc_feature: HIJSMM301C5XLC.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttccccaccctcctcgtatct

SEQ ID NO: 544341 - DNA, 502 bp, Homo sapiens
  misc_feature: HIJSMM301BYPUP.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctgttccccg

SEQ ID NO: 544342 - DNA, 490 bp, Homo sapiens; identical to SEQ ID NO: 541567
  misc_feature: HIJSMM301CORTM.22.65.F10.1.454.light.4.raw

SEQ ID NO: 544343 - DNA, 487 bp, Homo sapiens; identical to SEQ ID NO: 536206
  misc_feature: HIJSMM301APWER.47.38.D05.1.454.light.4.raw

SEQ ID NO: 544344 - DNA, 507 bp, Homo sapiens
  misc_feature: HIJSMM301AO4TU.52.37.D04.1.454.light.4.raw
cgcagtacgacacgaccggtgctcgatttagtagcatactgttgggtttgggggaggaactgctcagttaggacccagagggaaccatggaacccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 544345 - DNA, 501 bp, Homo sapiens
  misc_feature: HIJSMM301EPMYR.41.45.E01.1.454.light.4.raw
tctatactatcacgaccggtgctcgatttagtgagtcagtaagggaaaggggtgggtccaggaggcagaactctgggtgtctcaccatggcctggatccctctacttctccccctcctcactctctgcacaggctctgaggtcgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcactctcg

SEQ ID NO: 544346 - DNA, 492 bp, Homo sapiens
  misc_feature: HIJSMM301A2WPI.49.78.H01.1.454.light.4.raw
agtcgagagacacgaccggtgctcgatttagtgtgagtagtttgggtttgggggaactgctcagttaggacccagacggaaccatggaagctccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccgaaggtggagatcaaacgaactgtggctgcaccatctgtt

SEQ ID NO: 544347 - DNA, 508 bp, Homo sapiens
  misc_feature: HIJSMM301C2KFQ.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctcctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 544348 - DNA, 495 bp, Homo sapiens; identical to SEQ ID NO: 536931
  misc_feature: HIJSMM301CI2LB.10.33.C11.1.454.light.4.raw

SEQ ID NO: 544349 - DNA, 485 bp, Homo sapiens; identical to SEQ ID NO: 536630
  misc_feature: HIJSMM301EDRGI.13.56.F01.1.454.light.4.raw

SEQ ID NO: 544350 - DNA, 442 bp, Homo sapiens
  misc_feature: HIJSMM301DROY4.11.3.A03.1.454.light.4.raw
  modified_base (424)..(424): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggaccccacgtaaccgtcctaggtcagcccaaggctgccccctcggtcactctgttcccnccctcctcgtatctctcg

SEQ ID NO: 544351 - DNA, 495 bp, Homo sapiens; identical to SEQ ID NO: 535486
  misc_feature: HIJSMM301AWXS5.26.72.G06.1.454.light.4.raw

SEQ ID NO: 544352 - DNA, 487 bp, Homo sapiens; identical to SEQ ID NO: 536196
  misc_feature: HIJSMM301BW02P.11.28.C06.1.454.light.4.raw

SEQ ID NO: 544353 - DNA, 516 bp, Homo sapiens
  misc_feature: HIJSMM301C2HOH.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatattttgtcaggtgtgggagactaattttggtcatatgttgttcggcggagggaccaagctgaccgtcctcggtcagcccaaggctgccccctcggtcactctgttcccaccctcctc

SEQ ID NO: 544354 - DNA, 494 bp, Homo sapiens; identical to SEQ ID NO: 534992
  misc_feature: HIJSMM301AVGE7.9.1.A01.1.454.light.4.raw

SEQ ID NO: 544355 - DNA, 496 bp, Homo sapiens; identical to SEQ ID NO: 538149
  misc_feature: HIJSMM301EZ3XX.13.67.G01.1.454.light.4.raw

SEQ ID NO: 544356 - DNA, 444 bp, Homo sapiens; identical to SEQ ID NO: 535042
  misc_feature: HIJSMM301ASGBB.10.76.G10.1.454.light.4.raw

SEQ ID NO: 544357 - DNA, 486 bp, Homo sapiens; identical to SEQ ID NO: 535043
  misc_feature: HIJSMM301BR8S4.46.35.D02.1.454.light.4.raw

SEQ ID NO: 544358 - DNA, 484 bp, Homo sapiens
  misc_feature: HIJSMM301BKR7Y.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggaggatcaaacgaaactgtggctgcacc

SEQ ID NO: 544359 - DNA, 496 bp, Homo sapiens
  misc_feature: HIJSMM301BLVLT.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgactgtggctgcaccta

SEQ ID NO: 544360 - DNA, 492 bp, Homo sapiens; identical to SEQ ID NO: 536733
  misc_feature: HIJSMM301BGXM7.40.11.A11.1.454.light.4.raw

SEQ ID NO: 544361 - DNA, 492 bp, Homo sapiens; identical to SEQ ID NO: 536175
  misc_feature: HIJSMM301BOHPK.19.83.H06.1.454.light.4.raw

SEQ ID NO: 544362 - DNA, 447 bp, Homo sapiens; identical to SEQ ID NO: 535201
  misc_feature: HIJSMM301DAMVA.18.9.A09.1.454.light.4.raw

SEQ ID NO: 544363 - DNA, 487 bp, Homo sapiens; identical to SEQ ID NO: 538190
  misc_feature: HIJSMM301EQAS1.47.70.G04.1.454.light.4.raw

SEQ ID NO: 544364 - DNA, 520 bp, Homo sapiens
  misc_feature: HIJSMM301EBZ3G.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctcgccccctcggtcactctcgttcccgccctcctccacg

SEQ ID NO: 544365 - DNA, 441 bp, Homo sapiens; identical to SEQ ID NO: 534971
  misc_feature: HIJSMM301BNB77.11.3.A03.1.454.light.4.raw

SEQ ID NO: 544366 - DNA, 506 bp, Homo sapiens; identical to SEQ ID NO: 534969
  misc_feature: HIJSMM301B4VP0.18.37.D04.1.454.light.4.raw

SEQ ID NO: 544367 - DNA, 444 bp, Homo sapiens
  misc_feature: HIJSMM301BQ8GH.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctctgtcgagcgt

SEQ ID NO: 544368 - DNA, 474 bp, Homo sapiens; identical to SEQ ID NO: 538184
  misc_feature: HIJSMM301AE6GF.13.76.G10.1.454.light.4.raw

SEQ ID NO: 544369 - DNA, 499 bp, Homo sapiens
  misc_feature: HIJSMM301CN8XG.52.57.F02.1.454.light.4.raw
  modified_base (465)..(465): a, c, t, g, unknown or other
cgcagtacgacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagggtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtccngggtcagcccaaggccaacccactgtcactctcg

SEQ ID NO: 544370 - DNA, 485 bp, Homo sapiens; identical to SEQ ID NO: 535880
  misc_feature: HIJSMM301COB6F.7.75.G09.1.454.light.4.raw

SEQ ID NO: 544371 - DNA, 487 bp, Homo sapiens; identical to SEQ ID NO: 536536
  misc_feature: HIJSMM301AHFTM.26.45.E01.1.454.light.4.raw

SEQ ID NO: 544372 - DNA, 509 bp, Homo sapiens
  misc_feature: HIJSMM301CERGO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaacgaaactagtggctgcaccactctgtcttctatctttccccg

SEQ ID NO: 544373 - DNA, 510 bp, Homo sapiens
  misc_feature: HIJSMM301DNFID.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggaccgaaggtaggaaatacaaaacgaactagtggctgcaccatctgtcttcatcttccccg

SEQ ID NO: 544374 - DNA, 495 bp, Homo sapiens; identical to SEQ ID NO: 535007
  misc_feature: HIJSMM301CTACF.22.5.A05.1.454.light.4.raw

SEQ ID NO: 544375 - DNA, 501 bp, Homo sapiens
  misc_feature: HIJSMM301D004Z.21.8.A08.1.454.light.4.raw
tcgtcgctcgcacgaccggtgctcgatttagcatactctacagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtccttggtcagcccaaggctgccccctcggtcactctgttcccg

SEQ ID NO: 544376 - DNA, 489 bp, Homo sapiens
  misc_feature: HIJSMM301CDX7N.14.55.E11.1.454.light.4.raw
  modified_base (364)..(364): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtnagcagtctgcaacctgaagattttgcaacttactactgtcaacagagttacagtacccccctcactttcggcggagggaccaaggcggagatcagacgaactgtggctgcaccatctgtcttcta

SEQ ID NO: 544377 - DNA, 502 bp, Homo sapiens
  misc_feature: HIJSMM301CXXZF.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtccccactgttgtacttttcggcggagggaccaagctgaccgtcctaggtcagcccaaggctgccccctcggtcactctgttcccgccctcctcgctacgtaga

SEQ ID NO: 544378 - DNA, 496 bp, Homo sapiens
  misc_feature: HIJSMM301BOQKR.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgccctggagattaaagaactgtggctgcac

SEQ ID NO: 544379 - DNA, 483 bp, Homo sapiens
  misc_feature: HIJSMM301DZ6K6.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccgagggacaaggtacgaaatagagacgaactgtggctgcaccat

SEQ ID NO: 544380 - DNA, 499 bp, Homo sapiens
  misc_feature: HIJSMM301BL27F.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccgagggtggaaagtacaagcgaactgtggctgcaccatctgtcttc

SEQ ID NO: 544381 - DNA, 491 bp, Homo sapiens; identical to SEQ ID NO: 536211
  misc_feature: HIJSMM301BHGY5.16.53.E09.1.454.light.4.raw

SEQ ID NO: 544382 - DNA, 473 bp, Homo sapiens
  misc_feature: HIJSMM301A4982.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagat

SEQ ID NO: 544383 - DNA, 491 bp, Homo sapiens; identical to SEQ ID NO: 535294
  misc_feature: HIJSMM301D30K5.16.68.G02.1.454.light.4.raw

SEQ ID NO: 544384 - DNA, 484 bp, Homo sapiens; identical to SEQ ID NO: 535240
  misc_feature: HIJSMM301B27J1.47.60.F05.1.454.light.4.raw

SEQ ID NO: 544385 - DNA, 523 bp, Homo sapiens
  misc_feature: HIJSMM301DI4JG.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagttcgccccccacgtactcctaccgtccgaaccggaaggaccaccgtagtaggaattaaacgtaaaccgtagttggtcgtcgtcacccaactacttcgttcttcctact

SEQ ID NO: 544386 - DNA, 478 bp, Homo sapiens
  misc_feature: HIJSMM301C5GTH.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagatttgcagtttattactgtcagcactataataactggcctccgtacagttttggccaggggaccaagctggagatcaacgaa

SEQ ID NO: 544387 - DNA, 518 bp, Homo sapiens
  misc_feature: HIJSMM301CI1PM.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccgccctcctccacg

SEQ ID NO: 544388 - DNA, 447 bp, Homo sapiens
  misc_feature: HIJSMM301A3PYY.18.9.A09.1.454.light.4.raw
tacgagtatgcacgaccggtgctcgatttagcgagacgcgcagggtcctgggcccagtctgtgctgacgcagccgccctcagtgtctggggccccagggcaggagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 544389 - DNA, 492 bp, Homo sapiens
  misc_feature: HIJSMM301AO81J.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgtt

SEQ ID NO: 544390 - DNA, 534 bp, Homo sapiens
  misc_feature: HIJSMM301BAQFX.9.33.C11.1.454.light.4.raw
tgatacgtctcacgaccggtgctcgatttagagtgagctcgttgggtttggggtacgatttgatgttacctgatgcttagaggcttttcctggaagcagggcatttgttgcttcagcaccgtagtgcctcgtcatcacgcctcagccttgattttccggatttgcctggaaaccagcctacccgcttaaaccgggacaaccgtcgcccggccaacatagccttctccgtcccccttcgcagtaacaccaagtacaggaatattaacctgtttcccatcgactacgcctttcggcctcgccttagggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccctacccaacaacgcataagcgtcgctgccgcagcttcggtgcatggtttagccccgtttcatcttcccgcat

SEQ ID NO: 544391 - DNA, 497 bp, Homo sapiens; identical to SEQ ID NO: 535664
  misc_feature: HIJSMM301CSBHO.22.14.B03.1.454.light.4.raw

SEQ ID NO: 544392 - DNA, 515 bp, Homo sapiens
  misc_feature: HIJSMM301DCJ1H.49.11.A11.1.454.light.4.raw
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccaccctcctctctctccg

SEQ ID NO: 544393 - DNA, 502 bp, Homo sapiens
  misc_feature: HIJSMM301BRMMO.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacttcggccaagggaccagggtggaaatcagacgaactgtggctgcaccat

SEQ ID NO: 544394 - DNA, 480 bp, Homo sapiens; identical to SEQ ID NO: 535291
  misc_feature: HIJSMM301EH41V.22.59.F04.1.454.light.4.raw

SEQ ID NO: 544395 - DNA, 509 bp, Homo sapiens
  misc_feature: HIJSMM301DKFPU.48.23.C01.1.454.light.4.raw
agtatacatacacgaccggtgctcgatttagtacacgtgattagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgcccccc

SEQ ID NO: 544396 - DNA, 497 bp, Homo sapiens
  misc_feature: HIJSMM301AO96R.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctacggtcagccc

SEQ ID NO: 544397 - DNA, 484 bp, Homo sapiens
  misc_feature: HIJSMM301C1SYB.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcacca

SEQ ID NO: 544398 - DNA, 501 bp, Homo sapiens
  misc_feature: HIJSMM301AJA78.11.21.B10.1.454.light.4.raw
cgagagataccacgaccggtgctcgatttagtgtcgtcgcaaggagaggggggaggaactgctcagttaggacccagagggaaccatggaagccccacgctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 544399 - DNA, 482 bp, Homo sapiens
  misc_feature: HIJSMM301C17SE.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttatactgccaacaatataatagttattggacgttcggccaggggaccaaggtcgaaatgagacgaactgtggctgcaccat

SEQ ID NO: 544400 - DNA, 510 bp, Homo sapiens
  misc_feature: HIJSMM301D1R5I.22.30.C08.1.454.light.4.raw
acatacgcgtcacgaccggtgctcgatttagtctgacgtcaaagggaaaggggagctctgggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgcctcctc

SEQ ID NO: 544401 - DNA, 480 bp, Homo sapiens; identical to SEQ ID NO: 535630
  misc_feature: HIJSMM301DEPBG.40.59.F04.1.454.light.4.raw

SEQ ID NO: 544402 - DNA, 444 bp, Homo sapiens; identical to SEQ ID NO: 535856
  misc_feature: HIJSMM301D8930.9.9.A09.1.454.light.4.raw

SEQ ID NO: 544403 - DNA, 447 bp, Homo sapiens; identical to SEQ ID NO: 535201
  misc_feature: HIJSMM301CYBF0.18.9.A09.1.454.light.4.raw

SEQ ID NO: 544404 - DNA, 497 bp, Homo sapiens; identical to SEQ ID NO: 535664
  misc_feature: HIJSMM301BDTPM.22.14.B03.1.454.light.4.raw

SEQ ID NO: 544405 - DNA, 522 bp, Homo sapiens
  misc_feature: HIJSMM301BL8FD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtccactctgttcccaccct

SEQ ID NO: 544406 - DNA, 494 bp, Homo sapiens; identical to SEQ ID NO: 534992
  misc_feature: HIJSMM301BCPDK.9.1.A01.1.454.light.4.raw

SEQ ID NO: 544407 - DNA, 493 bp, Homo sapiens; identical to SEQ ID NO: 535745
  misc_feature: HIJSMM301DNRNJ.47.78.H01.1.454.light.4.raw

SEQ ID NO: 544408 - DNA, 441 bp, Homo sapiens; identical to SEQ ID NO: 535074
  misc_feature: HIJSMM301CLJGC.11.3.A03.1.454.light.4.raw

SEQ ID NO: 544409 - DNA, 500 bp, Homo sapiens
  misc_feature: HIJSMM301CCQMI.3.71.G05.1.454.light.4.raw
  modified_base (343)..(343): a, c, t, g, unknown or other
agacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacncagcttccttgaccatcactgggctcaggcggaagatgaggctgactatttactgtaacctcccgggccagcagtggtaacattgtgatattcggcggagggaccaaggtgaccgtcctacgtcagcccgaaggctgccccctcggtcactcttccg

SEQ ID NO: 544410 - DNA, 500 bp, Homo sapiens; identical to SEQ ID NO: 539795
  misc_feature: HIJSMM301BY8C0.22.38.D05.1.454.light.4.raw

SEQ ID NO: 544411 - DNA, 502 bp, Homo sapiens
  misc_feature: HIJSMM301CPE4T.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgccccctcggtcactctgtt

SEQ ID NO: 544412 - DNA, 504 bp, Homo sapiens
  misc_feature: HIJSMM301BGQPJ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataaatgactgggttttattcactttcggccctcgggaccgaaagtaggagtttctagacgaaactagtggcgtgcaccaatctgttcttccta

SEQ ID NO: 544413 - DNA, 483 bp, Homo sapiens
  misc_feature: HIJSMM301CSKF5.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccagggaccaagctggagatcaacgaactgtggctgcaccat

SEQ ID NO: 544414 - DNA, 503 bp, Homo sapiens; identical to SEQ ID NO: 536834
  misc_feature: HIJSMM301BG02M.2.35.D02.1.454.light.4.raw

SEQ ID NO: 544415 - DNA, 479 bp, Homo sapiens; identical to SEQ ID NO: 536050
  misc_feature: HIJSMM301BEMQR.5.73.G07.1.454.light.4.raw

SEQ ID NO: 544416 - DNA, 488 bp, Homo sapiens; identical to SEQ ID NO: 539612
  misc_feature: HIJSMM301AOZYS.3.55.E11.1.454.light.4.raw

SEQ ID NO: 544417 - DNA, 486 bp, Homo sapiens
  misc_feature: HIJSMM301CCVIW.41.21.B10.1.454.light.4.raw
tctatactatcacgaccggtgctcgatttagtgtcgtcgcaagggggaggaactgctcagttaggacccagagggaaccatggaagccccagctcagcttctcttcctcctgctactctggctcccagataccaccggacaaattgtgttgacacagtctccagccaccctgtctttgtctccaggggaaagagccaccctctcctgcagggccagtcagagtgttagcaaccacttagcctggtaccaacagagacctggccagactcccagactcgtcatctatgatgcatccaagagggccactggcatcccagccaggttcagtggcagtgggtctgggacagacttcactctcaccatcagcagcctagagcctgaagattttgcagtttattactgtcagcagcgtggcgactggcctcgcatcaccttcggccaagggacacgactggagactagacgaactgtggctgcaccatctgt

SEQ ID NO: 544418 - DNA, 470 bp, Homo sapiens
  misc_feature: HIJSMM301A1SL8.48.77.G11.1.454.light.4.raw
  modified_base (451)..(451): a, c, t, g, unknown or other
agtatacatacacgaccggtgctcgatttagctagtcactcaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacacttttggngttcggcggagggaccaag

SEQ ID NO: 544419 - DNA, 434 bp, Homo sapiens; identical to SEQ ID NO: 535153
  misc_feature: HIJSMM301B35A7.18.5.A05.1.454.light.4.raw

SEQ ID NO: 544420 - DNA, 512 bp, Homo sapiens
  misc_feature: HIJSMM301ED57F.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcccgtcgggaccgaaagtaggatatcaaacgaactgtggctgcaccatctgtcttcta

SEQ ID NO: 544421 - DNA, 505 bp, Homo sapiens
  misc_feature: HIJSMM301A7Q8F.22.21.B10.1.454.light.4.raw
acatacgcgtcacgaccggtgctcgatttagtgtcgtcgcaagggggggtctcagggggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctgtt

SEQ ID NO: 544422 - DNA, 494 bp, Homo sapiens; identical to SEQ ID NO: 534994
  misc_feature: HIJSMM301ECVBA.27.78.H01.1.454.light.4.raw

SEQ ID NO: 544423 - DNA, 491 bp, Homo sapiens; identical to SEQ ID NO: 536988
  misc_feature: HIJSMM301A9MEU.17.21.B10.1.454.light.4.raw

SEQ ID NO: 544424 - DNA, 528 bp, Homo sapiens
  misc_feature: HIJSMM301BVCPJ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgaccgtactcctaccgtccgaacggaacggaccacgtacgtaggaagtaaacgttaaacgtacgtggtcggtcgtcgacccaacctacttcgttcgttccttact

SEQ ID NO: 544425 - DNA, 497 bp, Homo sapiens; identical to SEQ ID NO: 536371
  misc_feature: HIJSMM301DB261.16.78.H01.1.454.light.4.raw

SEQ ID NO: 544426 - DNA, 504 bp, Homo sapiens
  misc_feature: HIJSMM301AQ38F.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacacccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtca

SEQ ID NO: 544427 - DNA, 475 bp, Homo sapiens; identical to SEQ ID NO: 543417
  misc_feature: HIJSMM301CI2WP.4.63.F08.1.454.light.4.raw

SEQ ID NO: 544428 - DNA, 493 bp, Homo sapiens
  misc_feature: HIJSMM301B7NOI.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccaatcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcgagggaccaaggtggagatcaacgaactgtggctgcaccatctgtctt

SEQ ID NO: 544429 - DNA, 487 bp, Homo sapiens; identical to SEQ ID NO: 535508
  misc_feature: HIJSMM301ASL4E.13.87.H10.1.454.light.4.raw

SEQ ID NO: 544430 - DNA, 490 bp, Homo sapiens
  misc_feature: HIJSMM301A1GBJ.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccatctgtcttc

SEQ ID NO: 544431 - DNA, 488 bp, Homo sapiens; identical to SEQ ID NO: 538628
  misc_feature: HIJSMM301CWTUU.40.8.A08.1.454.light.4.raw

SEQ ID NO: 544432 - DNA, 486 bp, Homo sapiens; identical to SEQ ID NO: 535385
  misc_feature: HIJSMM301BBUH5.19.71.G05.1.454.light.4.raw

SEQ ID NO: 544433 - DNA, 493 bp, Homo sapiens; identical to SEQ ID NO: 535047
  misc_feature: HIJSMM301B4JMF.16.53.E09.1.454.light.4.raw

SEQ ID NO: 544434 - DNA, 503 bp, Homo sapiens
  misc_feature: HIJSMM301BCWW9.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccgaagtggagtatcaaacgaactgtggctgcaccatctgt

SEQ ID NO: 544435 - DNA, 515 bp, Homo sapiens
  misc_feature: HIJSMM301DZ2JX.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtcccgtcctcggtttctggctccatcgcgggtcctccactactgcctccctcaccatctctggactgaagactgaggacgaggctgactactactgtcagtcttatgataacaccagggtgggtgttcggcggagggaccaagctggccgtcctaggtcacgcccaacggctgccccctcggtcactctgttcccgccctctcgagtagtaca

SEQ ID NO: 544436 - DNA, 505 bp, Homo sapiens
  misc_feature: HIJSMM301ELWRV.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggccaagggaccgaaggtggaaatcaaacgaactgtggctgcaccatctgtcttcatcttccccg

SEQ ID NO: 544437 - DNA, 485 bp, Homo sapiens
  misc_feature: HIJSMM301CX7UW.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgatacccctcgctcactttcggcggagggaccaaggtggagatcaaacgaactgtggctgcaccat

SEQ ID NO: 544438 - DNA, 511 bp, Homo sapiens
  misc_feature: HIJSMM301AOU6S.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaaggtaggaaagtacaaacgaactagtggcgtgcaccatctgtcttctatcttccccg

SEQ ID NO: 544439 - DNA, 491 bp, Homo sapiens; identical to SEQ ID NO: 535176
  misc_feature: HIJSMM301DGGJQ.13.39.D06.1.454.light.4.raw

SEQ ID NO: 544440 - DNA, 495 bp, Homo sapiens
  misc_feature: HIJSMM301EOKBG.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggagatacaaacgaactgtggctgcaccat

SEQ ID NO: 544441 - DNA, 495 bp, Homo sapiens
  misc_feature: HIJSMM301BTRXR.40.57.F02.1.454.light.4.raw
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaagg

SEQ ID NO: 544442 - DNA, 488 bp, Homo sapiens
  misc_feature: HIJSMM301DPZTC.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccat

SEQ ID NO: 544443 - DNA, 497 bp, Homo sapiens
  misc_feature: HIJSMM301EDVS7.51.39.D06.1.454.light.4.raw
cgatcgtatacacgaccggtgctcgatttagtgacatctcgcagttctttgggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaaccccactgtcact

SEQ ID NO: 544444 - DNA, 502 bp, Homo sapiens
  misc_feature: HIJSMM301BTKXZ.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggcc

SEQ ID NO: 544445 - DNA, 486 bp, Homo sapiens; identical to SEQ ID NO: 535043
  misc_feature: HIJSMM301CNZSA.46.35.D02.1.454.light.4.raw

SEQ ID NO: 544446 - DNA, 494 bp, Homo sapiens; identical to SEQ ID NO: 535276
  misc_feature: HIJSMM301BUWVO.16.6.A06.1.454.light.4.raw

SEQ ID NO: 544447 - DNA, 524 bp, Homo sapiens
  misc_feature: HIJSMM301D2SJF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgtaaacgaactacgtggcgtgcaccactctgtcttctatccttcccgtccctact

SEQ ID NO: 544448 - DNA, 493 bp, Homo sapiens
  misc_feature: HIJSMM301CHPQQ.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccacctcctcgctacgtaga

SEQ ID NO: 544449 - DNA, 505 bp, Homo sapiens
  misc_feature: HIJSMM301EQEAQ.7.87.H10.1.454.light.4.raw
cgtgtctctacacgaccggtgctcgatttagcagtactgcgttgggtttgggggagctgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgtcttcta

SEQ ID NO: 544450 - DNA, 506 bp, Homo sapiens
  misc_feature: HIJSMM301B7014.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtcactctgttcccg

SEQ ID NO: 544451 - DNA, 496 bp, Homo sapiens
  misc_feature: HIJSMM301AKOFH.48.56.F01.1.454.light.4.raw
agtatacatacacgaccggtgctcgatttagcagacgtctgaacacacaaagggggaagagctgctcagttaggacccagagggaaccatggaaaccccagcgcagcttctcttcctcctgctactctggctcccagataccaccggagaaattgtgttgacgcagtctccaggcaccctatctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggtggagatcaacgaactgtggctgcaccatctgtt

SEQ ID NO: 544452 - DNA, 447 bp, Homo sapiens; identical to SEQ ID NO: 535201
  misc_feature: HIJSMM301D1QCN.18.9.A09.1.454.light.4.raw

SEQ ID NO: 544453 - DNA, 495 bp, Homo sapiens
  misc_feature: HIJSMM301AEOLV.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcacttcggtcggagggaccgacggtggaggatacaaacgaacgtagtggtcgtgcaccactactgtt

SEQ ID NO: 544454 - DNA, 485 bp, Homo sapiens; identical to SEQ ID NO: 535653
  misc_feature: HIJSMM301ERUMZ.47.62.F07.1.454.light.4.raw

SEQ ID NO: 544455 - DNA, 447 bp, Homo sapiens; identical to SEQ ID NO: 535201
  misc_feature: HIJSMM301BDJPV.18.9.A09.1.454.light.4.raw

SEQ ID NO: 544456 - DNA, 419 bp, Homo sapiens; identical to SEQ ID NO: 541483
  misc_feature: HIJSMM301EL9DS.18.59.F04.1.454.light.4.raw

SEQ ID NO: 544457 - DNA, 489 bp, Homo sapiens
  misc_feature: HIJSMM301BZLH4.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaattttattactgtcagcaatataatacctggcctccgctcactttcggcggagggaccaaggttgagatcaaacgaactgtggctgcacca

SEQ ID NO: 544458 - DNA, 469 bp, Homo sapiens
  misc_feature: HIJSMM301BGPS0.40.48.E04.1.454.light.4.raw
tctagcgactcacgaccggtgctcgatttagagagcgtcacagagagaaggggaagtctctctcagtcaggacacagcatggacatgagggtccctgctcagctcctgggactcctgctgctctggctcccagatactagatgtgacatccagatgacccagtctccaccctccctgtctgcatctgtcggagacaaagtcaccatcacttgccgggcgagtcaagtcattagcaattatttagcctggtatcagcagaaaccagggcaaggtcctaaactcctgatctacgctgcatccactttgcactcaggggtcccatctcggttcaccggcagtggatctgggacagatttcactctcatcatcagcagcctgcagcctgaggatgttgcaacttattactgtcaaaagtataacattgcccccttcaccttcggccaagggacacgactggagattaaacgaa

SEQ ID NO: 544459 - DNA, 494 bp, Homo sapiens
  misc_feature: HIJSMM301ECH04.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtctgcgtcagcccaaggctgccccctcggtcactctgttccca

SEQ ID NO: 544460 - DNA, 492 bp, Homo sapiens; identical to SEQ ID NO: 537666
  misc_feature: HIJSMM301DJ7VE.43.33.C11.1.454.light.4.raw

SEQ ID NO: 544461 - DNA, 491 bp, Homo sapiens
  misc_feature: HIJSMM301EOXV1.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagtattttggaacttattattgtcaacagggtaacagtttcccgctcaccttcggcggagggaccaaggtggagatagaaaagaactgtggctgcaccat

SEQ ID NO: 544462 - DNA, 481 bp, Homo sapiens; identical to SEQ ID NO: 535993
  misc_feature: HIJSMM301BNZ7C.21.25.C03.1.454.light.4.raw

SEQ ID NO: 544463 - DNA, 486 bp, Homo sapiens
  misc_feature: HIJSMM301B4FIJ.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttacgtactgcatgcagggtacactctggccgttcacttttggccaggggaccaaactggatatcagacgaactgtgg

SEQ ID NO: 544464 - DNA, 484 bp, Homo sapiens; identical to SEQ ID NO: 535400
  misc_feature: HIJSMM301EREDT.46.26.C04.1.454.light.4.raw

SEQ ID NO: 544465 - DNA, 447 bp, Homo sapiens
  misc_feature: HIJSMM301BKONW.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 544466 - DNA, 500 bp, Homo sapiens; identical to SEQ ID NO: 535310
  misc_feature: HIJSMM301CNM6F.47.66.F11.1.454.light.4.raw

SEQ ID NO: 544467 - DNA, 515 bp, Homo sapiens
  misc_feature: HIJSMM301DT9QQ.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtggaaataaaacgaactgtggctgcaccatctgtcttcatccttccccg

SEQ ID NO: 544468 - DNA, 444 bp, Homo sapiens
  misc_feature: HIJSMM301A4B6W.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccaccctcctccgtttctgat

SEQ ID NO: 544469 - DNA, 484 bp, Homo sapiens; identical to SEQ ID NO: 535400
  misc_feature: HIJSMM301BTGDY.46.26.C04.1.454.light.4.raw

SEQ ID NO: 544470 - DNA, 494 bp, Homo sapiens
  misc_feature: HIJSMM301DTLC9.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtgctacttttcgggttttcggcggagggaccaagctgaccgtcctaggtcagcccaaggctgccccctc

SEQ ID NO: 544471 - DNA, 497 bp, Homo sapiens
  misc_feature: HIJSMM301CAS0X.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaaactgtggcgtgcaccactctgtcttcatcttccccg

SEQ ID NO: 544472 - DNA, 383 bp, Homo sapiens; identical to SEQ ID NO: 447524
  misc_feature: HIJSMM301CGFIT.41.26.C04.1.454.light.4.raw

SEQ ID NO: 544473 - DNA, 501 bp, Homo sapiens
  misc_feature: HIJSMM301ETX0P.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctggtcactctcg

SEQ ID NO: 544474 - DNA, 499 bp, Homo sapiens
  misc_feature: HIJSMM301CWZA8.49.24.C02.1.454.light.4.raw
agtcgagagacacgaccggtgctcgatttagtacagatcgttagggaaaggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccg

SEQ ID NO: 544475 - DNA, 497 bp, Homo sapiens
  misc_feature: HIJSMM301C91JP.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaacccactgt

SEQ ID NO: 544476 - DNA, 498 bp, Homo sapiens
  misc_feature: HIJSMM301DQOS1.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaaggaccaaggagcaaatcaaacgaaactgtggctgcaccactctgtcttcatcttcccgccat

SEQ ID NO: 544477 - DNA, 497 bp, Homo sapiens
  misc_feature: HIJSMM301BLQAN.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggtccgggggaccgaagctggagatcaaacgaaactgtggctgcaccatctgtcttcta

SEQ ID NO: 544478 - DNA, 494 bp, Homo sapiens; identical to SEQ ID NO: 535276
  misc_feature: HIJSMM301EK85Y.16.6.A06.1.454.light.4.raw

SEQ ID NO: 544479 - DNA, 502 bp, Homo sapiens; identical to SEQ ID NO: 537816
  misc_feature: HIJSMM301BS958.19.78.H01.1.454.light.4.raw

SEQ ID NO: 544480 - DNA, 466 bp, Homo sapiens; identical to SEQ ID NO: 535366
  misc_feature: HIJSMM301EIBP8.13.4.A04.1.454.light.4.raw

SEQ ID NO: 544481 - DNA, 502 bp, Homo sapiens
  misc_feature: HIJSMM301B8S18.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgacgtcctaggtcagcccaaggctgcccccc

SEQ ID NO: 544482 - DNA, 494 bp, Homo sapiens; identical to SEQ ID NO: 537501
  misc_feature: HIJSMM301ATN37.10.79.H02.1.454.light.4.raw

SEQ ID NO: 544483 - DNA, 505 bp, Homo sapiens
  misc_feature: HIJSMM301CYZEX.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaagctgccctcaccatcgcgggggcccaggcagatgatgagtgtgattattactgtgtgctctatatgggcagtggcgtttgggtgttcggcggagggaccaagctgaccgtcg

SEQ ID NO: 544484 - DNA, 486 bp, Homo sapiens; identical to SEQ ID NO: 535043
  misc_feature: HIJSMM301C9NWF.46.35.D02.1.454.light.4.raw

SEQ ID NO: 544485 - DNA, 509 bp, Homo sapiens
  misc_feature: HIJSMM301B1144.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggatcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccg

SEQ ID NO: 544486 - DNA, 489 bp, Homo sapiens; identical to SEQ ID NO: 535091
  misc_feature: HIJSMM301C750T.47.36.D03.1.454.light.4.raw

SEQ ID NO: 544487 - DNA, 486 bp, Homo sapiens; identical to SEQ ID NO: 535043
  misc_feature: HIJSMM301B7LQJ.46.35.D02.1.454.light.4.raw

SEQ ID NO: 544488 - DNA, 488 bp, Homo sapiens
  misc_feature: HIJSMM301EOPVP.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccgaaggaccgaaggtaggaaagtacaaacgaactgtggctgcaccta

SEQ ID NO: 544489 - DNA, 486 bp, Homo sapiens; identical to SEQ ID NO: 536329
  misc_feature: HIJSMM301CO2IE.21.4.A04.1.454.light.4.raw

SEQ ID NO: 544490 - DNA, 501 bp, Homo sapiens; identical to SEQ ID NO: 535746
  misc_feature: HIJSMM301A4LGF.18.11.A11.1.454.light.4.raw

SEQ ID NO: 544491 - DNA, 513 bp, Homo sapiens; identical to SEQ ID NO: 535719
  misc_feature: HIJSMM301AIIHR.17.33.C11.1.454.light.4.raw

SEQ ID NO: 544492 - DNA, 512 bp, Homo sapiens
  misc_feature: HIJSMM301DIHRN.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgaagtaca

SEQ ID NO: 544493 - DNA, 508 bp, Homo sapiens
  misc_feature: HIJSMM301B5P3W.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagccctgaagattttgcagtttattactgtcaacagcgtagcagcaggcctccggcgacgttcggccagggaccaaggtggaagtcaagcgaactgtggctgcaccatctgtcttcatcttcccgcc

SEQ ID NO: 544494 - DNA, 508 bp, Homo sapiens
  misc_feature: HIJSMM301BXKY3.22.46.E02.1.454.light.4.raw
  modified_base (504)..(504): a, c, t, g, unknown or other
acatacgcgtcacgaccggtgctcgatttagactcatctacagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctcggtnactc

SEQ ID NO: 544495 - DNA, 511 bp, Homo sapiens
  misc_feature: HIJSMM301AE6DL.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaagtcagcccaaggctgccccctcggtcactctgttcccca

SEQ ID NO: 544496 - DNA, 493 bp, Homo sapiens; identical to SEQ ID NO: 535047
  misc_feature: HIJSMM301A0JBX.16.53.E09.1.454.light.4.raw

SEQ ID NO: 544497 - DNA, 493 bp, Homo sapiens; identical to SEQ ID NO: 535047
  misc_feature: HIJSMM301C27YZ.16.53.E09.1.454.light.4.raw

SEQ ID NO: 544498 - DNA, 486 bp, Homo sapiens
  misc_feature: HIJSMM301EYYV2.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgccgacgggacgacggtggagtgtcaagcgaactagtggcgtgcaccact

SEQ ID NO: 544499 - DNA, 490 bp, Homo sapiens; identical to SEQ ID NO: 536481
  misc_feature: HIJSMM301CTSSL.13.46.E02.1.454.light.4.raw

SEQ ID NO: 544500 - DNA, 485 bp, Homo sapiens; identical to SEQ ID NO: 535880
  misc_feature: HIJSMM301ALP4H.7.75.G09.1.454.light.4.raw

SEQ ID NO: 544501 - DNA, 466 bp, Homo sapiens; identical to SEQ ID NO: 536398
  misc_feature: HIJSMM301AGFM7.3.20.B09.1.454.light.4.raw

SEQ ID NO: 544502 - DNA, 497 bp, Homo sapiens
  misc_feature: HIJSMM301B68KW.11.57.F02.1.454.light.4.raw
cgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacatggccaggctccccggctcctcatctatggtgcatccaccagggccgctggtgtcccacccaggttcagtggcggtgggtctgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatt

SEQ ID NO: 544503 - DNA, 500 bp, Homo sapiens; identical to SEQ ID NO: 535310
  misc_feature: HIJSMM301EPQSW.47.66.F11.1.454.light.4.raw

SEQ ID NO: 544504 - DNA, 490 bp, Homo sapiens
  misc_feature: HIJSMM301B2385.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggccaagggaccaaggtggaaatacaaacgaactagtggctgcaccatctgtctt

SEQ ID NO: 544505 - DNA, 491 bp, Homo sapiens
  misc_feature: HIJSMM301DWX5E.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcca

SEQ ID NO: 544506 - DNA, 495 bp, Homo sapiens; identical to SEQ ID NO: 535596
  misc_feature: HIJSMM301AIRML.10.79.H02.1.454.light.4.raw

SEQ ID NO: 544507 - DNA, 499 bp, Homo sapiens
  misc_feature: HIJSMM301D38IX.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatcctgtcttcta

SEQ ID NO: 544508 - DNA, 502 bp, Homo sapiens
  misc_feature: HIJSMM301DZB2S.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaaagtagatgtcaacgaactgtggctgcaccatctgtctt

SEQ ID NO: 544509 - DNA, 507 bp, Homo sapiens
  misc_feature: HIJSMM301CYNAP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaaactgaccgtcctagggtccagccccaa

SEQ ID NO: 544510 - DNA, 486 bp, Homo sapiens
  misc_feature: HIJSMM301C3CBO.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccaaggtggataatcagacgaa

SEQ ID NO: 544511 - DNA, 459 bp, Homo sapiens
  misc_feature: HIJSMM301BUK0W.11.86.H09.1.454.light.4.raw
cgagagataccacgaccggtgctcgatttagtgctatagacttgggtttggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctcg

SEQ ID NO: 544512 - DNA, 520 bp, Homo sapiens
  misc_feature: HIJSMM301AGDAC.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccgaaggtggcaatcaaccgaactagtggctgcaccatctgtcttcatcttccccg

SEQ ID NO: 544513 - DNA, 447 bp, Homo sapiens; identical to SEQ ID NO: 535882
  misc_feature: HIJSMM301BSA7U.18.9.A09.1.454.light.4.raw
  modified_base (429)..(429): a, c, t, g, unknown or other

SEQ ID NO: 544514 - DNA, 501 bp, Homo sapiens
  misc_feature: HIJSMM301BSHBC.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatttgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaacgaactgtggctgcaccatctgtcttcatcttccccg

SEQ ID NO: 544515 - DNA, 501 bp, Homo sapiens
  misc_feature: HIJSMM301A9VQD.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtcctaggtcagctcaaggccaacccactgt

SEQ ID NO: 544516 - DNA, 504 bp, Homo sapiens
  misc_feature: HIJSMM301CSX8G.48.30.C08.1.454.light.4.raw
  modified_base (403)..(403): a, c, t, g, unknown or other
agtatacatacacgaccggtgctcgatttagtctgacgtcaaagggaaagggggtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctnttactgtcatcagacttttagtttacgtcggaccttcggccaagggacacgactggagattaaacgaactgtggctgcaccatctgtcttcatcttccccg

SEQ ID NO: 544517 - DNA, 494 bp, Homo sapiens; identical to SEQ ID NO: 534992
  misc_feature: HIJSMM301A8QYA.9.1.A01.1.454.light.4.raw

SEQ ID NO: 544518 - DNA, 495 bp, Homo sapiens; identical to SEQ ID NO: 538434
  misc_feature: HIJSMM301EHX0K.51.81.H04.1.454.light.4.raw

SEQ ID NO: 544519 - DNA, 496 bp, Homo sapiens
  misc_feature: HIJSMM301EKWGB.40.55.E11.1.454.light.4.raw
tctagcgactcacgaccggtgctcgatttagcactcgcacgttgggtttgggggagtcagacccactcaggacacagcatggacatgagggtccccgctcagctcctggggctcctgctgctctggctcccaggtgccagatgtgccatccagatgacccagtctccatcctccctgtctgtatctgtaggagacaaagtcaccatcacttgccgggcaagtcaggacattagaaatgaattagcctggtttcagcagaaaccagggaaagcccctaagctcctgatctatgctgcatccactttagaaatggggtcccatcaagattcagcggcagtggatctggcacagatttcactctcaccgtcagcagcctgcagtctgaagattttgcaacttattactgtctacaagattataattaccctcggacgtcggtccagggaccgaacggtaggaagtgtcgaagacggaactacgtggcgtgcgaccaact

SEQ ID NO: 544520 - DNA, 482 bp, Homo sapiens
  misc_feature: HIJSMM301BW5Q4.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 544521 - DNA, 453 bp, Homo sapiens
  misc_feature: HIJSMM301BVDKE.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 544522 - DNA, 505 bp, Homo sapiens
  misc_feature: HIJSMM301EISM3.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgcat

SEQ ID NO: 544523 - DNA, 488 bp, Homo sapiens
  misc_feature: HIJSMM301A3Q0V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgacagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccat

SEQ ID NO: 544524 - DNA, 500 bp, Homo sapiens
  misc_feature: HIJSMM301AJI0O.19.71.G05.1.454.light.4.raw
  modified_base (408)..(408): a, c, t, g, unknown or other
  modified_base (485)..(485): a, c, t, g, unknown or other
  modified_base (490)..(490): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatntggcagtttattaattgtcaacaaatattattataacttcttgacgtcgtcgacggacgaacgtaggagtagtatanagaanaacgtagcgt

SEQ ID NO: 544525 - DNA, 502 bp, Homo sapiens
  misc_feature: HIJSMM301BO1UZ.18.78.H01.1.454.light.4.raw
tacgagtatgcacgaccggtgctcgatttagtgtgagtagtttgggtttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccc

SEQ ID NO: 544526 - DNA, 485 bp, Homo sapiens; identical to SEQ ID NO: 536075
  misc_feature: HIJSMM301EAYE1.17.21.B10.1.454.light.4.raw

SEQ ID NO: 544527 - DNA, 497 bp, Homo sapiens; identical to SEQ ID NO: 535740
  misc_feature: HIJSMM301CLGES.3.71.G05.1.454.light.4.raw

SEQ ID NO: 544528 - DNA, 494 bp, Homo sapiens
  misc_feature: HIJSMM301BLO2R.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgctagtttattactgtcagcagcgtagcaactggcctctcaccttcggcggagggaccaaggtggagatcaaacgaactggtggcgtgcaccatctgtt

SEQ ID NO: 544529 - DNA, 494 bp, Homo sapiens
  misc_feature: HIJSMM301CMIP8.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtccctcgaggttcagtggcagtggatctgggacacatttcaccctcaccatcaatagcctggaagctgaagatgctgcaacttattactgtcatcagagtactactttacctcaagtgatcaccttcgaccaagggacacgactggagattaaacgaactgtggctgcaccatctgtctt

SEQ ID NO: 544530 - DNA, 454 bp, Homo sapiens; identical to SEQ ID NO: 534964
  misc_feature: HIJSMM301CP14U.19.86.H09.1.454.light.4.raw

SEQ ID NO: 544531 - DNA, 490 bp, Homo sapiens
  misc_feature: HIJSMM301DB5SJ.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaacgggacgagggtggaaagtacaaacgaactagtgcgtgcaccatctgtcttt

SEQ ID NO: 544532 - DNA, 492 bp, Homo sapiens
  misc_feature: HIJSMM301ANGHA.8.81.H04.1.454.light.4.raw
ctcgcgtgtccacgaccggtgctcgatttagtagtgtagattcgcgggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccggggaccaagctggagatcaaacgaactgtggctgcaccatctgtcttcta

SEQ ID NO: 544533 - DNA, 495 bp, Homo sapiens; identical to SEQ ID NO: 535596
  misc_feature: HIJSMM301EYYP4.10.79.H02.1.454.light.4.raw

SEQ ID NO: 544534 - DNA, 492 bp, Homo sapiens; identical to SEQ ID NO: 536087
  misc_feature: HIJSMM301B05IG.10.17.B06.1.454.light.4.raw

SEQ ID NO: 544535 - DNA, 489 bp, Homo sapiens
  misc_feature: HIJSMM301BXGV4.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagagtcaaacgaaa

SEQ ID NO: 544536 - DNA, 485 bp, Homo sapiens; identical to SEQ ID NO: 536040
  misc_feature: HIJSMM301DJ8LS.15.1.A01.1.454.light.4.raw

SEQ ID NO: 544537 - DNA, 521 bp, Homo sapiens; identical to SEQ ID NO: 539470
  misc_feature: HIJSMM301DDSRU.27.23.C01.1.454.light.4.raw

SEQ ID NO: 544538 - DNA, 515 bp, Homo sapiens
  misc_feature: HIJSMM301EOCR5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaaggtaggaagtacgaaacgaactagtggcgtgcaccactctgtcttctatcttcccgccact

SEQ ID NO: 544539 - DNA, 486 bp, Homo sapiens
  misc_feature: HIJSMM301B1AMJ.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactagtggctgcaccatctgt

SEQ ID NO: 544540 - DNA, 498 bp, Homo sapiens
  misc_feature: HIJSMM301CL2RV.41.20.B09.1.454.light.4.raw
tctatactatcacgaccggtgctcgatttagtgtagtgtgaagggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggagatcaaaggaactgtggctgcaccatctgtcttcatcttcccgccta

SEQ ID NO: 544541 - DNA, 486 bp, Homo sapiens; identical to SEQ ID NO: 535043
  misc_feature: HIJSMM301B4P9I.46.35.D02.1.454.light.4.raw

SEQ ID NO: 544542 - DNA, 481 bp, Homo sapiens; identical to SEQ ID NO: 535993
  misc_feature: HIJSMM301ATD76.21.25.C03.1.454.light.4.raw

SEQ ID NO: 544543 - DNA, 486 bp, Homo sapiens; identical to SEQ ID NO: 535043
  misc_feature: HIJSMM301BT6W6.46.35.D02.1.454.light.4.raw

SEQ ID NO: 544544 - DNA, 447 bp, Homo sapiens; identical to SEQ ID NO: 535201
  misc_feature: HIJSMM301DR3IW.18.9.A09.1.454.light.4.raw

SEQ ID NO: 544545 - DNA, 495 bp, Homo sapiens; identical to SEQ ID NO: 536931
  misc_feature: HIJSMM301AO50H.10.33.C11.1.454.light.4.raw

SEQ ID NO: 544546 - DNA, 494 bp, Homo sapiens; identical to SEQ ID NO: 534992
  misc_feature: HIJSMM301D8670.9.1.A01.1.454.light.4.raw

SEQ ID NO: 544547 - DNA, 503 bp, Homo sapiens
  misc_feature: HIJSMM301AX1P3.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccacttcggcggagggaccaaaataagaggtcaaacgaactagtggctgcaccatctgtcttcatt

SEQ ID NO: 544548 - DNA, 496 bp, Homo sapiens
  misc_feature: HIJSMM301AR23J.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaacgggaccgaacggtaggaagtcaaacgaactagtggctgcaccatctgtctt

SEQ ID NO: 544549 - DNA, 495 bp, Homo sapiens; identical to SEQ ID NO: 539326
  misc_feature: HIJSMM301B4RSL.52.86.H09.1.454.light.4.raw

SEQ ID NO: 544550 - DNA, 494 bp, Homo sapiens; identical to SEQ ID NO: 534994
  misc_feature: HIJSMM301ELDSM.27.78.H01.1.454.light.4.raw

SEQ ID NO: 544551 - DNA, 505 bp, Homo sapiens
  misc_feature: HIJSMM301ET8K3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttgccaggaccaaggtagaaggtacaaacgaactagtggctgcaccatctgcttcatcttcccgtccact

SEQ ID NO: 544552 - DNA, 467 bp, Homo sapiens
  misc_feature: HIJSMM301D7VO1.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggagacaaagtcaccgatcgacttaggccgggcaaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccaggggaccgacggtggatgtcaagcgaactgtggctgcaccatctgtcttcatcttcccgccactctgaactactcaca

SEQ ID NO: 544553 - DNA, 486 bp, Homo sapiens; identical to SEQ ID NO: 535043
  misc_feature: HIJSMM301CU8EE.46.35.D02.1.454.light.4.raw

SEQ ID NO: 544554 - DNA, 493 bp, Homo sapiens
  misc_feature: HIJSMM301BJOPN.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgttcagcagtatgatacctggcctccgtacacttttggccggggaccaagctggaaatcaagcgaactgtggctgcaccatctgtcttcatt

SEQ ID NO: 544555 - DNA, 511 bp, Homo sapiens
  misc_feature: HIJSMM301AVUOK.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaaactgtggctgcaccatctgtcttcatcttcccg

SEQ ID NO: 544556 - DNA, 490 bp, Homo sapiens
  misc_feature: HIJSMM301BI8S0.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttacttcggccctgggaccaaagtggatatcaaacgaactgtggctgcaccat

SEQ ID NO: 544557 - DNA, 493 bp, Homo sapiens
  misc_feature: HIJSMM301B8FVN.13.5.A05.1.454.light.4.raw
tcacgtactacacgaccggtgctcgatttagatagatagacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttcccg

SEQ ID NO: 544558 - DNA, 514 bp, Homo sapiens
  misc_feature: HIJSMM301EVPEB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgccgacggaccgaacggtaggaagtacgaaacgaactacgtggctgtcaccactctgtcttctactcttccgccact

SEQ ID NO: 544559 - DNA, 511 bp, Homo sapiens
  misc_feature: HIJSMM301DV5UX.10.71.G05.1.454.light.4.raw
catagtagtgcacgaccggtgctcgatttagtgtcgtcgcaagagagaggggggacgtgctcagttaggacccacgagggaaccgatggaagccccacgctcagcttctcttcctcctgctactctggctcccacgacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtggggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatcttccccg

SEQ ID NO: 544560 - DNA, 494 bp, Homo sapiens; identical to SEQ ID NO: 534992
  misc_feature: HIJSMM301CSK3H.9.1.A01.1.454.light.4.raw

SEQ ID NO: 544561 - DNA, 524 bp, Homo sapiens
  misc_feature: HIJSMM301DWDJM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgaacggaccgaacggtaggaagtacgaaacgaactagtggcgtgcaccactctgtcttctactcttcccgtccactcctgat

SEQ ID NO: 544562 - DNA, 497 bp, Homo sapiens; identical to SEQ ID NO: 538061
  misc_feature: HIJSMM301EK4V1.16.46.E02.1.454.light.4.raw

SEQ ID NO: 544563 - DNA, 440 bp, Homo sapiens; identical to SEQ ID NO: 537628
  misc_feature: HIJSMM301CNT7J.41.9.A09.1.454.light.4.raw

SEQ ID NO: 544564 - DNA, 495 bp, Homo sapiens; identical to SEQ ID NO: 535821
  misc_feature: HIJSMM301BNOD0.3.31.C09.1.454.light.4.raw

SEQ ID NO: 544565 - DNA, 498 bp, Homo sapiens
  misc_feature: HIJSMM301CYGRA.11.21.B10.1.454.light.4.raw
cgagagataccacgaccggtgctcgatttagtgtcgtcgcaaggagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaacgaactgtggctgcaccatctgtcttcatcttccccg

SEQ ID NO: 544566 - DNA, 518 bp, Homo sapiens; identical to SEQ ID NO: 535407
  misc_feature: HIJSMM301AYS3G.22.30.C08.1.454.light.4.raw

SEQ ID NO: 544567 - DNA, 503 bp, Homo sapiens
  misc_feature: HIJSMM301CXTM2.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 544568 - DNA, 485 bp, Homo sapiens; identical to SEQ ID NO: 535880
  misc_feature: HIJSMM301ALN8S.7.75.G09.1.454.light.4.raw

SEQ ID NO: 544569 - DNA, 502 bp, Homo sapiens
  misc_feature: HIJSMM301DL16P.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccacctccc

SEQ ID NO: 544570 - DNA, 496 bp, Homo sapiens
  misc_feature: HIJSMM301AHIWO.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaacgaactgtggctgcaccatctgtcttc

SEQ ID NO: 544571 - DNA, 473 bp, Homo sapiens; identical to SEQ ID NO: 538875
  misc_feature: HIJSMM301EAPG2.4.75.G09.1.454.light.4.raw

SEQ ID NO: 544572 - DNA, 478 bp, Homo sapiens; identical to SEQ ID NO: 535129
  misc_feature: HIJSMM301AZAIW.11.11.A11.1.454.light.4.raw

SEQ ID NO: 544573 - DNA, 509 bp, Homo sapiens
  misc_feature: HIJSMM301AGAS1.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttcccgccat

SEQ ID NO: 544574 - DNA, 484 bp, Homo sapiens; identical to SEQ ID NO: 535240
  misc_feature: HIJSMM301DD5SX.47.60.F05.1.454.light.4.raw

SEQ ID NO: 544575 - DNA, 490 bp, Homo sapiens
  misc_feature: HIJSMM301BPI3Q.17.67.G01.1.454.light.4.raw
cgtagactagcacgaccggtgctcgatttagagtatacatattgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcacagcattagcagctatttaaattggtatcagcagaaaccagggagagcccctaacctcctgatctatgctgcatccagtttgcagagtggggtcccatcaaggttcagtggcagtggatctgggacagatttcactctcaccatcagcagtctgcaacctgaagattttgcaacttactactgtcaacagagtctcagtaccccccggacgttcggccggacggaccgaacggtgggaaagtacaaacgaacagttggctgcacca

SEQ ID NO: 544576 - DNA, 444 bp, Homo sapiens; identical to SEQ ID NO: 535856
  misc_feature: HIJSMM301EIUZ6.9.9.A09.1.454.light.4.raw

SEQ ID NO: 544577 - DNA, 444 bp, Homo sapiens; identical to SEQ ID NO: 534993
  misc_feature: HIJSMM301DH0YT.5.9.A09.1.454.light.4.raw

SEQ ID NO: 544578 - DNA, 494 bp, Homo sapiens
  misc_feature: HIJSMM301B7627.26.77.G11.1.454.light.4.raw
agactatactcacgaccggtgctcgatttagctagtcactcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccaggggacccaggtggagatcagacgaactgtggctgcaccatctgtcttcatcttcccg

SEQ ID NO: 544579 - DNA, 491 bp, Homo sapiens; identical to SEQ ID NO: 538021
  misc_feature: HIJSMM301BD3YG.3.72.G06.1.454.light.4.raw

SEQ ID NO: 544580 - DNA, 447 bp, Homo sapiens; identical to SEQ ID NO: 535201
  misc_feature: HIJSMM301D1Z7X.18.9.A09.1.454.light.4.raw

SEQ ID NO: 544581 - DNA, 515 bp, Homo sapiens
  misc_feature: HIJSMM301DVVJL.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcct

SEQ ID NO: 544582 - DNA, 489 bp, Homo sapiens
  misc_feature: HIJSMM301CT1EY.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcat

SEQ ID NO: 544583 - DNA, 485 bp, Homo sapiens; identical to SEQ ID NO: 535880
  misc_feature: HIJSMM301CTMWK.7.75.G09.1.454.light.4.raw

SEQ ID NO: 544584 - DNA, 494 bp, Homo sapiens; identical to SEQ ID NO: 542264
  misc_feature: HIJSMM301DHUCV.13.6.A06.1.454.light.4.raw

SEQ ID NO: 544585 - DNA, 508 bp, Homo sapiens
  misc_feature: HIJSMM301D4RLL.48.66.F11.1.454.light.4.raw
agtatacatacacgaccggtgctcgatttagtcacgcgagaagggcttgatgccttggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctc

SEQ ID NO: 544586 - DNA, 490 bp, Homo sapiens; identical to SEQ ID NO: 535234
  misc_feature: HIJSMM301CH7J5.17.21.B10.1.454.light.4.raw

SEQ ID NO: 544587 - DNA, 500 bp, Homo sapiens
  misc_feature: HIJSMM301A8WV2.43.34.D01.1.454.light.4.raw
tgtgagtagtcacgaccggtgctcgatttagatcgtctgtgttgggtttggggtctgtgttgggtttgggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcacg

SEQ ID NO: 544588 - DNA, 482 bp, Homo sapiens
  misc_feature: HIJSMM301EIFX2.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaacgaactgtggctgca

SEQ ID NO: 544589 - DNA, 444 bp, Homo sapiens; identical to SEQ ID NO: 535027
  misc_feature: HIJSMM301AJQND.8.73.G07.1.454.light.4.raw

SEQ ID NO: 544590 - DNA, 487 bp, Homo sapiens; identical to SEQ ID NO: 538190
  misc_feature: HIJSMM301BFFP7.47.70.G04.1.454.light.4.raw

SEQ ID NO: 544591 - DNA, 477 bp, Homo sapiens; identical to SEQ ID NO: 535122
  misc_feature: HIJSMM301B2XQV.26.72.G06.1.454.light.4.raw

SEQ ID NO: 544592 - DNA, 495 bp, Homo sapiens; identical to SEQ ID NO: 535596
  misc_feature: HIJSMM301BYYHN.10.79.H02.1.454.light.4.raw

SEQ ID NO: 544593 - DNA, 494 bp, Homo sapiens; identical to SEQ ID NO: 534994
  misc_feature: HIJSMM301C2VPT.27.78.H01.1.454.light.4.raw

SEQ ID NO: 544594 - DNA, 493 bp, Homo sapiens
  misc_feature: HIJSMM301CPUHF.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctggggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccat

SEQ ID NO: 544595 - DNA, 489 bp, Homo sapiens; identical to SEQ ID NO: 536013
  misc_feature: HIJSMM301B2ZXE.26.23.C01.1.454.light.4.raw

SEQ ID NO: 544596 - DNA, 478 bp, Homo sapiens
  misc_feature: HIJSMM301EHWVN.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcgcggcggac

SEQ ID NO: 544597 - DNA, 447 bp, Homo sapiens; identical to SEQ ID NO: 535201
  misc_feature: HIJSMM301EKXU2.18.9.A09.1.454.light.4.raw

SEQ ID NO: 544598 - DNA, 481 bp, Homo sapiens; identical to SEQ ID NO: 535993
  misc_feature: HIJSMM301CXQI1.21.25.C03.1.454.light.4.raw

SEQ ID NO: 544599 - DNA, 491 bp, Homo sapiens
  misc_feature: HIJSMM301CYMP0.9.19.B08.1.454.light.4.raw
tgatacgtctcacgaccggtgctcgatttagtgagtcagtaagggggcttcagctgtgggcacaagaggcagcactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcgggcaggttatgatgtccactggtaccagcagtttccaggaacagcccccagggtcctcatctttggttacagtaatcggccctcaggggtccctgaccgattctctggctccaagtctgacacctcagcctccctggccatcactgggctccagactgaggatgaggctcattattactgccagtcttatgacaacgtcagaacatttggtgttcggcggagggaccaagctgaccgtcctcagtcagaccccg

SEQ ID NO: 544600 - DNA, 487 bp, Homo sapiens
  misc_feature: HIJSMM301EPXXM.48.78.H01.1.454.light.4.raw
agtatacatacacgaccggtgctcgatttagtgtgagtagtttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcgagggaccaagctgacagtcctaggtcagcccaaggctcg

SEQ ID NO: 544601 - DNA, 486 bp, Homo sapiens; identical to SEQ ID NO: 537617
  misc_feature: HIJSMM301EOYII.10.53.E09.1.454.light.4.raw

SEQ ID NO: 544602 - DNA, 475 bp, Homo sapiens
  misc_feature: HIJSMM301DPRSN.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgccgctatgtcttcggaactgggaccaaggtcaccgtcctaagtcagcccc

SEQ ID NO: 544603 - DNA, 503 bp, Homo sapiens; identical to SEQ ID NO: 538884
  misc_feature: HIJSMM301DUFIF.27.78.H01.1.454.light.4.raw

SEQ ID NO: 544604 - DNA, 518 bp, Homo sapiens; identical to SEQ ID NO: 543515
  misc_feature: HIJSMM301A6IF4.43.81.H04.1.454.light.4.raw

SEQ ID NO: 544605 - DNA, 496 bp, Homo sapiens
  misc_feature: HIJSMM301EN4V0.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcgcaggacgaacggtaggacgagtcaaacgaaactagtggcgtgcgaccactctgtctt

SEQ ID NO: 544606 - DNA, 486 bp, Homo sapiens; identical to SEQ ID NO: 535385
  misc_feature: HIJSMM301A8HIN.19.71.G05.1.454.light.4.raw

SEQ ID NO: 544607 - DNA, 494 bp, Homo sapiens; identical to SEQ ID NO: 534994
  misc_feature: HIJSMM301DF0SC.27.78.H01.1.454.light.4.raw

SEQ ID NO: 544608 - DNA, 504 bp, Homo sapiens; identical to SEQ ID NO: 540689
  misc_feature: HIJSMM301A5002.21.38.D05.1.454.light.4.raw

SEQ ID NO: 544609 - DNA, 506 bp, Homo sapiens; identical to SEQ ID NO: 534969
  misc_feature: HIJSMM301COFQ8.18.37.D04.1.454.light.4.raw

SEQ ID NO: 544610 - DNA, 503 bp, Homo sapiens; identical to SEQ ID NO: 535044
  misc_feature: HIJSMM301EKFHU.19.78.H01.1.454.light.4.raw

SEQ ID NO: 544611 - DNA, 497 bp, Homo sapiens; identical to SEQ ID NO: 535664
  misc_feature: HIJSMM301C0G1H.22.14.B03.1.454.light.4.raw

SEQ ID NO: 544612 - DNA, 471 bp, Homo sapiens; identical to SEQ ID NO: 539388
  misc_feature: HIJSMM301C18SG.13.39.D06.1.454.light.4.raw

SEQ ID NO: 544613 - DNA, 495 bp, Homo sapiens; identical to SEQ ID NO: 535596
  misc_feature: HIJSMM301DKDLZ.10.79.H02.1.454.light.4.raw

SEQ ID NO: 544614 - DNA, 512 bp, Homo sapiens
  misc_feature: HIJSMM301EPH5W.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccacggaccgaacggtaggaagtacaaacgaactagtggcgtgcaccatctgtcttcatcttcccgccact

SEQ ID NO: 544615 - DNA, 508 bp, Homo sapiens
  misc_feature: HIJSMM301DCBSH.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgttgggtgttcggcggagggaccaagttgaccgtcctaggtcagcccaaggctgccccctcggtcactctgtt

SEQ ID NO: 544616 - DNA, 460 bp, Homo sapiens; identical to SEQ ID NO: 537107
  misc_feature: HIJSMM301CA52V.22.28.C06.1.454.light.4.raw

SEQ ID NO: 544617 - DNA, 475 bp, Homo sapiens
  misc_feature: HIJSMM301B8M9T.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaac

SEQ ID NO: 544618 - DNA, 491 bp, Homo sapiens; identical to SEQ ID NO: 535294
  misc_feature: HIJSMM301B246J.16.68.G02.1.454.light.4.raw

SEQ ID NO: 544619 - DNA, 500 bp, Homo sapiens; identical to SEQ ID NO: 535310
  misc_feature: HIJSMM301ANNY3.47.66.F11.1.454.light.4.raw

SEQ ID NO: 544620 - DNA, 498 bp, Homo sapiens
  misc_feature: HIJSMM301BGNHD.12.86.H09.1.454.light.4.raw
  modified_base (198)..(198): a, c, t, g, unknown or other
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcat

SEQ ID NO: 544621 - DNA, 487 bp, Homo sapiens
  misc_feature: HIJSMM301BV1XS.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctctggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 544622 - DNA, 484 bp, Homo sapiens
  misc_feature: HIJSMM301CXN62.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcat

SEQ ID NO: 544623 - DNA, 496 bp, Homo sapiens; identical to SEQ ID NO: 535109
  misc_feature: HIJSMM301A30FS.16.78.H01.1.454.light.4.raw

SEQ ID NO: 544624 - DNA, 498 bp, Homo sapiens
  misc_feature: HIJSMM301BUTDV.4.11.A11.1.454.light.4.raw
  modified_base (472)..(472): a, c, t, g, unknown or other
agcactgtagcacgaccggtgctcgatttagctacgactgcaggggcagcaagatggtgttgcagacccaggtcttcatttctctgttgctctggatctctggtgccctcggggacatcgtgatgacccagtctccagactccctggctgtgtctctgggcgggtgggccacgatacgaactgactaagtccagccagagtctttttatacgggtccgacggtaagaattatttagcttggtatcagcaaaagccaggacagcctcctaagttgctcatttactgggcgactttccgtgattacggggtccctctccggttcagtggcggcgggtctgggacagacttcactctcaccatcgacagcctgcaggatgaagatgtggcagtctatttctgtcagcaatattatactactccccggacattcggccaagggaccaaggtggagatcaagcgaactgtggctgcnccatctgtcttcatcttcccgccact

SEQ ID NO: 544625 - DNA, 486 bp, Homo sapiens
  misc_feature: HIJSMM301A0FLC.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccgaacggtggaaatacaaacgaactagtggctgcaccta

SEQ ID NO: 544626 - DNA, 495 bp, Homo sapiens; identical to SEQ ID NO: 535007
  misc_feature: HIJSMM301B0CJP.22.5.A05.1.454.light.4.raw

SEQ ID NO: 544627 - DNA, 537 bp, Homo sapiens
  misc_feature: HIJSMM301BLFRM.17.37.D04.1.454.light.4.raw
cgtagactagcacgaccggtgctcgatttagtagcatactgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcgggacgggaccgaagctcggaccgttccgttcggtcgacgacccgaacggcgtccgcccccgtcggtccactcttcgttcccctacccctt

SEQ ID NO: 544628 - DNA, 416 bp, Homo sapiens
  misc_feature: HIJSMM301BLQ5O.18.78.H01.1.454.light.4.raw
  modified_base (381)..(381): a, c, t, g, unknown or other
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccnctgtcactctgttcccaccctcctccatactcgta

SEQ ID NO: 544629 - DNA, 486 bp, Homo sapiens; identical to SEQ ID NO: 535043
  misc_feature: HIJSMM301BS0Y0.46.35.D02.1.454.light.4.raw

SEQ ID NO: 544630 - DNA, 484 bp, Homo sapiens
  misc_feature: HIJSMM301A2UPB.52.37.D04.1.454.light.4.raw
  modified_base (436)..(436): a, c, t, g, unknown or other
cgcagtacgacacgaccggtgctcgatttagtagcatactgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtcctaggtcagcccaaggctcg

SEQ ID NO: 544631 - DNA, 507 bp, Homo sapiens
  misc_feature: HIJSMM301CLABN.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagcctgaccgtcctaggtcagcccaaggctgccccctcggt

SEQ ID NO: 544632 - DNA, 502 bp, Homo sapiens
  misc_feature: HIJSMM301C9OFP.48.67.G01.1.454.light.4.raw
agtatacatacacgaccggtgctcgatttagagtatacatattgggttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 544633 - DNA, 504 bp, Homo sapiens
  misc_feature: HIJSMM301DC4V3.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcttcggccaagggaccaaggtggaaatacaaacgaactgtggctgcaccaactctgtcttcatcttccccg

SEQ ID NO: 544634 - DNA, 454 bp, Homo sapiens; identical to SEQ ID NO: 536943
  misc_feature: HIJSMM301CAXN0.19.86.H09.1.454.light.4.raw

SEQ ID NO: 544635 - DNA, 489 bp, Homo sapiens; identical to SEQ ID NO: 535139
  misc_feature: HIJSMM301C20XA.14.55.E11.1.454.light.4.raw

SEQ ID NO: 544636 - DNA, 501 bp, Homo sapiens; identical to SEQ ID NO: 536867
  misc_feature: HIJSMM301AXWSO.5.86.H09.1.454.light.4.raw

SEQ ID NO: 544637 - DNA, 484 bp, Homo sapiens; identical to SEQ ID NO: 535441
  misc_feature: HIJSMM301AQZPZ.26.60.F05.1.454.light.4.raw

SEQ ID NO: 544638 - DNA, 502 bp, Homo sapiens; identical to SEQ ID NO: 541501
  misc_feature: HIJSMM301ENWSL.17.27.C05.1.454.light.4.raw

SEQ ID NO: 544639 - DNA, 507 bp, Homo sapiens
  misc_feature: HIJSMM301BK8ZZ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaacgtggatatcaaacgaactagtggctgcaccatctgtt

SEQ ID NO: 544640 - DNA, 504 bp, Homo sapiens; identical to SEQ ID NO: 538977
  misc_feature: HIJSMM301DZ3VC.48.37.D04.1.454.light.4.raw

SEQ ID NO: 544641 - DNA, 494 bp, Homo sapiens; identical to SEQ ID NO: 534994
  misc_feature: HIJSMM301A6SVD.27.78.H01.1.454.light.4.raw

SEQ ID NO: 544642 - DNA, 494 bp, Homo sapiens; identical to SEQ ID NO: 542264
  misc_feature: HIJSMM301DLD2K.13.6.A06.1.454.light.4.raw

SEQ ID NO: 544643 - DNA, 502 bp, Homo sapiens; identical to SEQ ID NO: 544444
  misc_feature: HIJSMM301BDJ61.5.24.C02.1.454.light.4.raw

SEQ ID NO: 544644 - DNA, 521 bp, Homo sapiens
  misc_feature: HIJSMM301AKESZ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacggaccgaacggtaggaaggtacgaaacgaaactagtaggcgtgcgaccactctgtcttctatcttcccgtccact

SEQ ID NO: 544645 - DNA, 485 bp, Homo sapiens
  misc_feature: HIJSMM301ED2KM.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccgtcctcctctacgtgagct

SEQ ID NO: 544646 - DNA, 501 bp, Homo sapiens; identical to SEQ ID NO: 535746
  misc_feature: HIJSMM301BS69R.18.11.A11.1.454.light.4.raw

SEQ ID NO: 544647 - DNA, 492 bp, Homo sapiens; identical to SEQ ID NO: 539740
  misc_feature: HIJSMM301AZVCU.11.81.H04.1.454.light.4.raw

SEQ ID NO: 544648 - DNA, 471 bp, Homo sapiens
  misc_feature: HIJSMM301AVPKX.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactagtgg

SEQ ID NO: 544649 - DNA, 524 bp, Homo sapiens
  misc_feature: HIJSMM301ADVFS.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggaagtactaacgaaaacctacgtggtcggtcgtcgaccacctactcgttcgttcctta

SEQ ID NO: 544650 - DNA, 486 bp, Homo sapiens; identical to SEQ ID NO: 535385
  misc_feature: HIJSMM301BLWM8.19.71.G05.1.454.light.4.raw

SEQ ID NO: 544651 - DNA, 486 bp, Homo sapiens
  misc_feature: HIJSMM301C3PN1.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaaggaccaaggtggaactacaacgaa

SEQ ID NO: 544652 - DNA, 495 bp, Homo sapiens
  misc_feature: HIJSMM301CTFDZ.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccaacggtggaaggtacaaacgaactagtggctgcaccatctgtctt

SEQ ID NO: 544653 - DNA, 484 bp, Homo sapiens
  misc_feature: HIJSMM301EIZN3.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatcaaacgaactagtggctgcaccatct

SEQ ID NO: 544654 - DNA, 493 bp, Homo sapiens; identical to SEQ ID NO: 541469
  misc_feature: HIJSMM301CXEMT.5.57.F02.1.454.light.4.raw

SEQ ID NO: 544655 - DNA, 488 bp, Homo sapiens
  misc_feature: HIJSMM301AQDJ1.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgtcggccaggaccaaggtaggaaagtacaaacgaactagtggctgcaccact

SEQ ID NO: 544656 - DNA, 519 bp, Homo sapiens
  misc_feature: HIJSMM301AYYLZ.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 544657 - DNA, 486 bp, Homo sapiens; identical to SEQ ID NO: 535043
  misc_feature: HIJSMM301AFHYQ.46.35.D02.1.454.light.4.raw

SEQ ID NO: 544658 - DNA, 475 bp, Homo sapiens
  misc_feature: HIJSMM301BBBKY.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggactctgggacagattttactttcaccatcagcaggcctgcagcctgaagatattgcaacatattactgtcaacagtatgataatctcccactcactttcggcggagggaccaaggtggagatcaaacgaactgtggc

SEQ ID NO: 544659 - DNA, 501 bp, Homo sapiens
  misc_feature: HIJSMM301D8I2C.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 544660 - DNA, 447 bp, Homo sapiens; identical to SEQ ID NO: 535201
  misc_feature: HIJSMM301DFT2R.18.9.A09.1.454.light.4.raw

SEQ ID NO: 544661 - DNA, 482 bp, Homo sapiens; identical to SEQ ID NO: 538815
  misc_feature: HIJSMM301ER14P.4.34.D01.1.454.light.4.raw

SEQ ID NO: 544662 - DNA, 508 bp, Homo sapiens; identical to SEQ ID NO: 536062
  misc_feature: HIJSMM301C83EN.11.57.F02.1.454.light.4.raw

SEQ ID NO: 544663 - DNA, 466 bp, Homo sapiens; identical to SEQ ID NO: 535366
  misc_feature: HIJSMM301EX2C1.13.4.A04.1.454.light.4.raw

SEQ ID NO: 544664 - DNA, 506 bp, Homo sapiens; identical to SEQ ID NO: 534969
  misc_feature: HIJSMM301B13I3.18.37.D04.1.454.light.4.raw

SEQ ID NO: 544665 - DNA, 482 bp, Homo sapiens
  misc_feature: HIJSMM301AG5Q5.8.14.B03.1.454.light.4.raw
ctcgcgtgtccacgaccggtgctcgatttagtgtgagtagtactgcgggggtaagaggttgtgtccaccatggcctggactcctctcctcctcctgttcctctctcactgcacaggttccctctcgcagactgtgctgactcagccggcttccctctctgcatctcctggagcatcagccaatgtcacctgcaccttgcccagtggcatcaatttccatacctttagtgtatattggtatcagcagaagccagggagtcctccccactatctcctgaggtataaaacagactcagataaggagcaggcctctggagtccccagccgcttctctggatccaaagatgctgcggccaatgcagggagtttgctcatctctgggctccagtttgaggatgaggctgactattattgtatgatttggtacaggagcgcttgggtgatcggcggagggaccaagctgaccgtcctaggtcagcccaa

SEQ ID NO: 544666 - DNA, 493 bp, Homo sapiens
  misc_feature: HIJSMM301BDKP9.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcaccatctgt

SEQ ID NO: 544667 - DNA, 490 bp, Homo sapiens
  misc_feature: HIJSMM301CKALK.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccaaggtggagatcaaacgaactgtggctgcaccatct

SEQ ID NO: 544668 - DNA, 504 bp, Homo sapiens; identical to SEQ ID NO: 535709
  misc_feature: HIJSMM301AIK0O.9.55.E11.1.454.light.4.raw

SEQ ID NO: 544669 - DNA, 484 bp, Homo sapiens; identical to SEQ ID NO: 535240
  misc_feature: HIJSMM301EUCBJ.47.60.F05.1.454.light.4.raw

SEQ ID NO: 544670 - DNA, 488 bp, Homo sapiens; identical to SEQ ID NO: 538612
  misc_feature: HIJSMM301A5VFB.4.59.F04.1.454.light.4.raw

SEQ ID NO: 544671 - DNA, 444 bp, Homo sapiens
  misc_feature: HIJSMM301EI76O.2.76.G10.1.454.light.4.raw
acgctcgacacacgaccggtgctcgatttagtcactcatacagggtcctgggcccagtctgtgctgactcagccaccctcagcgtctgggccccccggcgagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 544672 - DNA, 520 bp, Homo sapiens
  misc_feature: HIJSMM301D2Z6H.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccgccct

SEQ ID NO: 544673 - DNA, 486 bp, Homo sapiens; identical to SEQ ID NO: 535385
  misc_feature: HIJSMM301BXA53.19.71.G05.1.454.light.4.raw

SEQ ID NO: 544674 - DNA, 497 bp, Homo sapiens
  misc_feature: HIJSMM301AZAAY.40.59.F04.1.454.light.4.raw
tctagcgactcacgaccggtgctcgatttagtacacacacttagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatt

SEQ ID NO: 544675 - DNA, 504 bp, Homo sapiens; identical to SEQ ID NO: 542288
  misc_feature: HIJSMM301BY0RX.8.28.C06.1.454.light.4.raw

SEQ ID NO: 544676 - DNA, 497 bp, Homo sapiens; identical to SEQ ID NO: 535764
  misc_feature: HIJSMM301B2F7Q.22.20.B09.1.454.light.4.raw

SEQ ID NO: 544677 - DNA, 504 bp, Homo sapiens
  misc_feature: HIJSMM301ERNT5.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactgtggctgcaccatctgtctt

SEQ ID NO: 544678 - DNA, 486 bp, Homo sapiens; identical to SEQ ID NO: 535043
  misc_feature: HIJSMM301EB5I6.46.35.D02.1.454.light.4.raw

SEQ ID NO: 544679 - DNA, 493 bp, Homo sapiens; identical to SEQ ID NO: 535047
  misc_feature: HIJSMM301ASNV4.16.53.E09.1.454.light.4.raw

SEQ ID NO: 544680 - DNA, 449 bp, Homo sapiens
  misc_feature: HIJSMM301C6LEG.18.9.A09.1.454.light.4.raw
tacgagtatgcacgaccggtgctcgatttagcgagacgcgcagggtccgtgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggcccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 544681 - DNA, 479 bp, Homo sapiens; identical to SEQ ID NO: 535586
  misc_feature: HIJSMM301AQ868.13.34.D01.1.454.light.4.raw

SEQ ID NO: 544682 - DNA, 448 bp, Homo sapiens
  misc_feature: HIJSMM301EX88E.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctccctccatactcgta

SEQ ID NO: 544683 - DNA, 392 bp, Homo sapiens
  misc_feature: HIJSMM301ED023.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactacctcatctataggaataatcagcggccctcaggggtcccgtgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttccccgccctcctccgagcgacga

SEQ ID NO: 544684 - DNA, 488 bp, Homo sapiens
  misc_feature: HIJSMM301DB83X.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtgg

SEQ ID NO: 544685 - DNA, 487 bp, Homo sapiens
  misc_feature: HIJSMM301E2585.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatt

SEQ ID NO: 544686 - DNA, 503 bp, Homo sapiens
  misc_feature: HIJSMM301BQ76C.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccagcagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctc

SEQ ID NO: 544687 - DNA, 485 bp, Homo sapiens; identical to SEQ ID NO: 535880
  misc_feature: HIJSMM301BBSVD.7.75.G09.1.454.light.4.raw

SEQ ID NO: 544688 - DNA, 494 bp, Homo sapiens
  misc_feature: HIJSMM301A2NL7.17.43.D10.1.454.light.4.raw
cgtagactagcacgaccggtgctcgatttagactagcagtaagggggaggaactgctcagttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtgtcccagccagattcaggggcagtgggtctgggacagagttcactctcaccatcagcagcctgcagtctgaagattttgcagtttattactgtcagcactataataactggcccccggggggacgttcggccaagggaccaaggtggagatcaaacgaactgtggctgcaccatctgtcttcat

SEQ ID NO: 544689 - DNA, 484 bp, Homo sapiens
  misc_feature: HIJSMM301BURF1.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgcccccc

SEQ ID NO: 544690 - DNA, 498 bp, Homo sapiens
  misc_feature: HIJSMM301CKET6.41.6.A06.1.454.light.4.raw
tctatactatcacgaccggtgctcgatttagatctactgacagggggctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccta

SEQ ID NO: 544691 - DNA, 484 bp, Homo sapiens
  misc_feature: HIJSMM301CD5HM.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcagcccaaggctgccccctcggtcactctgttcccaccctcctcgctacgtaga

SEQ ID NO: 544692 - DNA, 469 bp, Homo sapiens; identical to SEQ ID NO: 536091
  misc_feature: HIJSMM301B0QZD.3.82.H05.1.454.light.4.raw

SEQ ID NO: 544693 - DNA, 472 bp, Homo sapiens
  misc_feature: HIJSMM301AGL6E.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaagtaggatatcaaacgaactgtggctgcaccatctgtcttcatcttcccgccat

SEQ ID NO: 544694 - DNA, 495 bp, Homo sapiens; identical to SEQ ID NO: 536055
  misc_feature: HIJSMM301A0OAM.47.38.D05.1.454.light.4.raw

SEQ ID NO: 544695 - DNA, 506 bp, Homo sapiens; identical to SEQ ID NO: 534969
  misc_feature: HIJSMM301BUTQV.18.37.D04.1.454.light.4.raw

SEQ ID NO: 544696 - DNA, 493 bp, Homo sapiens
  misc_feature: HIJSMM301AMZFH.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtggaggatcaaacgaacta

SEQ ID NO: 544697 - DNA, 488 bp, Homo sapiens; identical to SEQ ID NO: 535081
  misc_feature: HIJSMM301BX4JT.26.23.C01.1.454.light.4.raw

SEQ ID NO: 544698 - DNA, 495 bp, Homo sapiens
  misc_feature: HIJSMM301DCCS7.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaagggtggagatcaaacgaactgtggctgcaccatctgtcttcatcttccgcc

SEQ ID NO: 544699 - DNA, 441 bp, Homo sapiens; identical to SEQ ID NO: 534971
  misc_feature: HIJSMM301AI4OX.11.3.A03.1.454.light.4.raw

SEQ ID NO: 544700 - DNA, 484 bp, Homo sapiens
  misc_feature: HIJSMM301A0R2S.41.78.H01.1.454.light.4.raw
tctatactatcacgaccggtgctcgatttagtgtgagtagtttgggtttggggtgatcaggacttctcagttcatcttctcaccatgaggctccctgctcagctcctggggctgctaatgctctggatacctggatccagtgcagatattgtgatgtcccagactccactctctctgtccgtcacccctggacagccggcctccatctcctgcaagtctagtcagagtctcctccatgagaatggcaaaacttatttctactggtacctacagaaggcaggccagccgccacagctcctgatctatgaggttttcaggcggttctctggagtgccagacaggttcagtggcagcgggtccgggacagatttcacactgaggatcagtcgggtggaggctgacgacgttgggacttattactgcgcgcaaagtctacaccttcctctcactttgggccctgggaccaaagtggacatcaaacgaa

SEQ ID NO: 544701 - DNA, 505 bp, Homo sapiens; identical to SEQ ID NO: 535987
  misc_feature: HIJSMM301D3ELT.18.37.D04.1.454.light.4.raw

SEQ ID NO: 544702 - DNA, 468 bp, Homo sapiens; identical to SEQ ID NO: 541534
  misc_feature: HIJSMM301E0DBD.7.81.H04.1.454.light.4.raw

SEQ ID NO: 544703 - DNA, 484 bp, Homo sapiens
  misc_feature: HIJSMM301BXJVM.41.22.B11.1.454.light.4.raw
tctatactatcacgaccggtgctcgatttagacgacagctcagggggaatcagacccagtcaggacacagcatggacatgagagtcctcgctcagctcctggggctcctgctgctctgtttcccaggtgccagatgtgacatccagatgacccagtctccatcctcactgtctgcatctgtacgagacagagtcaccatcacttgtcgggcgagtcaggtcattagcaattctttagcctggtttcagcagaaaccagggaaagcccctaagtccctgatccatagtgcttccagtttgcagagtggggtcccattaaagttcagcggcaatggatttgggacacatttcagtctcaccatcagcagcctacagcctgaagattgtgcaacttattactgccaacagtattttacttacccttggacgttcggccaagggaccaaggtggaaatcaatcgaactgtggctgcaccatctgtctt

SEQ ID NO: 544704 - DNA, 509 bp, Homo sapiens
  misc_feature: HIJSMM301A1TXA.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaataagaggtacgaaacgaaacgtagtggtcgtgcaccatctgtcttc

SEQ ID NO: 544705 - DNA, 486 bp, Homo sapiens; identical to SEQ ID NO: 536008
  misc_feature: HIJSMM301D68FE.52.83.H06.1.454.light.4.raw

SEQ ID NO: 544706 - DNA, 444 bp, Homo sapiens; identical to SEQ ID NO: 534993
  misc_feature: HIJSMM301B5RE7.5.9.A09.1.454.light.4.raw

SEQ ID NO: 544707 - DNA, 484 bp, Homo sapiens; identical to SEQ ID NO: 535400
  misc_feature: HIJSMM301DPRBM.46.26.C04.1.454.light.4.raw

SEQ ID NO: 544708 - DNA, 508 bp, Homo sapiens
  misc_feature: HIJSMM301CUZ3Q.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaacagttttctcggggcgttcggccaagggaccaaggtggaaatcaaacgaacctagtggctggcaccatcctgtcttcatcttccccg

SEQ ID NO: 544709 - DNA, 479 bp, Homo sapiens
  misc_feature: HIJSMM301BFNWO.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccaggggaccgaaagtggatgtcaaccgaacctgtggctgcacca

SEQ ID NO: 544710 - DNA, 486 bp, Homo sapiens; identical to SEQ ID NO: 535043
  misc_feature: HIJSMM301CVM3Q.46.35.D02.1.454.light.4.raw

SEQ ID NO: 544711 - DNA, 492 bp, Homo sapiens; identical to SEQ ID NO: 534967
  misc_feature: HIJSMM301C8SEI.47.64.F09.1.454.light.4.raw

SEQ ID NO: 544712 - DNA, 499 bp, Homo sapiens; identical to SEQ ID NO: 535698
  misc_feature: HIJSMM301AIZ3Q.12.86.H09.1.454.light.4.raw

SEQ ID NO: 544713 - DNA, 518 bp, Homo sapiens
  misc_feature: HIJSMM301BSWFE.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccctcctcgagt

SEQ ID NO: 544714 - DNA, 491 bp, Homo sapiens
  misc_feature: HIJSMM301AFZY2.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgcat

SEQ ID NO: 544715 - DNA, 383 bp, Homo sapiens
  misc_feature: HIJSMM301DKGED.49.27.C05.1.454.light.4.raw
agtcgagagacacgaccggtgctcgatttagacgcgatcgaagggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagcggcagtggatctgggacagagttcactctcaccatcagcagcctgcagcctgatgattttgcaacttattactgccaacagtataatagttattcgtatactttggccaggggaccaagctggagatcaaacgaactgtggctgcaccatctgtcttcatcttcccgccatctgatctctcgact

SEQ ID NO: 544716 - DNA, 490 bp, Homo sapiens; identical to SEQ ID NO: 535234
  misc_feature: HIJSMM301DMAXR.17.21.B10.1.454.light.4.raw

SEQ ID NO: 544717 - DNA, 518 bp, Homo sapiens
  misc_feature: HIJSMM301CHW7U.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcaccg

SEQ ID NO: 544718 - DNA, 494 bp, Homo sapiens
  misc_feature: HIJSMM301DSIX6.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttcatt

SEQ ID NO: 544719 - DNA, 488 bp, Homo sapiens; identical to SEQ ID NO: 535081
  misc_feature: HIJSMM301D2XKB.26.23.C01.1.454.light.4.raw

SEQ ID NO: 544720 - DNA, 500 bp, Homo sapiens
  misc_feature: HIJSMM301B25Z5.14.3.A03.1.454.light.4.raw
cgtctagtaccacgaccggtgctcgatttagagagcgtcacagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgccccctcggtcact

SEQ ID NO: 544721 - DNA, 454 bp, Homo sapiens; identical to SEQ ID NO: 534964
  misc_feature: HIJSMM301BPOB9.19.86.H09.1.454.light.4.raw

SEQ ID NO: 544722 - DNA, 487 bp, Homo sapiens; identical to SEQ ID NO: 538190
  misc_feature: HIJSMM301CFV07.47.70.G04.1.454.light.4.raw

SEQ ID NO: 544723 - DNA, 506 bp, Homo sapiens; identical to SEQ ID NO: 540259
  misc_feature: HIJSMM301B00PS.15.5.A05.1.454.light.4.raw

SEQ ID NO: 544724 - DNA, 423 bp, Homo sapiens; identical to SEQ ID NO: 538400
  misc_feature: HIJSMM301ES0SK.9.25.C03.1.454.light.4.raw

SEQ ID NO: 544725 - DNA, 504 bp, Homo sapiens; identical to SEQ ID NO: 535561
  misc_feature: HIJSMM301AR2NB.4.57.F02.1.454.light.4.raw

SEQ ID NO: 544726 - DNA, 461 bp, Homo sapiens
  misc_feature: HIJSMM301DG6ON.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 544727 - DNA, 447 bp, Homo sapiens; identical to SEQ ID NO: 535201
  misc_feature: HIJSMM301A8S0F.18.9.A09.1.454.light.4.raw

SEQ ID NO: 544728 - DNA, 491 bp, Homo sapiens
  misc_feature: HIJSMM301CZYQ6.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaatgtggctgcaccatctgtcttcta

SEQ ID NO: 544729 - DNA, 503 bp, Homo sapiens
  misc_feature: HIJSMM301C0XG5.40.53.E09.1.454.light.4.raw
tctagcgactcacgaccggtgctcgatttagagagagtgtgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcctaggtcagcccaaggctgccccctc

SEQ ID NO: 544730 - DNA, 489 bp, Homo sapiens; identical to SEQ ID NO: 535139
  misc_feature: HIJSMM301A3DXS.14.55.E11.1.454.light.4.raw

SEQ ID NO: 544731 - DNA, 494 bp, Homo sapiens; identical to SEQ ID NO: 534992
  misc_feature: HIJSMM301BA8BT.9.1.A01.1.454.light.4.raw

SEQ ID NO: 544732 - DNA, 493 bp, Homo sapiens
  misc_feature: HIJSMM301DNOW4.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtgct

SEQ ID NO: 544733 - DNA, 485 bp, Homo sapiens
  misc_feature: HIJSMM301A27J0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggaggatcaaacgaa

SEQ ID NO: 544734 - DNA, 493 bp, Homo sapiens
  misc_feature: HIJSMM301DV01M.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcagcagtataattactggctcgtttttggccagggaccaagctggagatcaagcgaactgtggctgcaccatctgtcttcatcttccccg

SEQ ID NO: 544735 - DNA, 484 bp, Homo sapiens
  misc_feature: HIJSMM301BVYW8.41.23.C01.1.454.light.4.raw
tctatactatcacgaccggtgctcgatttagtacacgtgattagggattggggctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccaagctgaccgtccttggtcagcccaagg

SEQ ID NO: 544736 - DNA, 500 bp, Homo sapiens; identical to SEQ ID NO: 542309
  misc_feature: HIJSMM301CY44I.12.86.H09.1.454.light.4.raw

SEQ ID NO: 544737 - DNA, 483 bp, Homo sapiens; identical to SEQ ID NO: 541577
  misc_feature: HIJSMM301CM69Y.47.60.F05.1.454.light.4.raw

SEQ ID NO: 544738 - DNA, 441 bp, Homo sapiens
  misc_feature: HIJSMM301C2T2G.11.3.A03.1.454.light.4.raw
  modified_base (423)..(423): a, c, t, g, unknown or other
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccncctcctccgtatctctcg

SEQ ID NO: 544739 - DNA, 498 bp, Homo sapiens
  misc_feature: HIJSMM301ASJFS.13.38.D05.1.454.light.4.raw
tcacgtactacacgaccggtgctcgatttagtatctgatagttgggtttgggggagctacaacaggcaggcaggggcgagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaactgt

SEQ ID NO: 544740 - DNA, 447 bp, Homo sapiens; identical to SEQ ID NO: 535201
  misc_feature: HIJSMM301DRRII.18.9.A09.1.454.light.4.raw

SEQ ID NO: 544741 - DNA, 485 bp, Homo sapiens; identical to SEQ ID NO: 535501
  misc_feature: HIJSMM301E0SIL.3.10.A10.1.454.light.4.raw

SEQ ID NO: 544742 - DNA, 504 bp, Homo sapiens
  misc_feature: HIJSMM301AOL9A.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctagggtcagccccaa

SEQ ID NO: 544743 - DNA, 374 bp, Homo sapiens
  misc_feature: HIJSMM301EXSNO.49.42.D09.1.454.light.4.raw
agtcgagagacacgaccggtgctcgatttagacacatacgcagggaaagggccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccatctgtcttcatcttcccgccatctgatctctcgact

SEQ ID NO: 544744 - DNA, 514 bp, Homo sapiens
  misc_feature: HIJSMM301CBPRR.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatgtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctccggtcacgt

SEQ ID NO: 544745 - DNA, 444 bp, Homo sapiens; identical to SEQ ID NO: 534993
  misc_feature: HIJSMM301BVIE6.5.9.A09.1.454.light.4.raw

SEQ ID NO: 544746 - DNA, 446 bp, Homo sapiens
  misc_feature: HIJSMM301AXEFO.18.9.A09.1.454.light.4.raw
  modified_base (411)..(411): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctagtcagcccaaggccaaccccnctgtcactctgttcccaccctcctccatactcgta

SEQ ID NO: 544747 - DNA, 447 bp, Homo sapiens; identical to SEQ ID NO: 535201
  misc_feature: HIJSMM301EEUVU.18.9.A09.1.454.light.4.raw

SEQ ID NO: 544748 - DNA, 488 bp, Homo sapiens
  misc_feature: HIJSMM301EW523.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaaactgtggctgcaccatctgtt

SEQ ID NO: 544749 - DNA, 494 bp, Homo sapiens; identical to SEQ ID NO: 534992
  misc_feature: HIJSMM301DNRV3.9.1.A01.1.454.light.4.raw

SEQ ID NO: 544750 - DNA, 490 bp, Homo sapiens; identical to SEQ ID NO: 542820
  misc_feature: HIJSMM301CKAL2.11.12.B01.1.454.light.4.raw

SEQ ID NO: 544751 - DNA, 474 bp, Homo sapiens
  misc_feature: HIJSMM301EDXK1.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccgaaggtggagatcaaacgaa

SEQ ID NO: 544752 - DNA, 488 bp, Homo sapiens
  misc_feature: HIJSMM301B49NJ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggcggagggaccaaggcggagatcagacgaactgtggctgcaccatctgtcttcta

SEQ ID NO: 544753 - DNA, 503 bp, Homo sapiens
  misc_feature: HIJSMM301BJ7BA.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgc

SEQ ID NO: 544754 - DNA, 491 bp, Homo sapiens
  misc_feature: HIJSMM301B147W.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaagtcaccgtcctgggtcagcccaaggccaaccccactgtcact

SEQ ID NO: 544755 - DNA, 507 bp, Homo sapiens
  misc_feature: HIJSMM301ES95Q.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgcc

SEQ ID NO: 544756 - DNA, 492 bp, Homo sapiens; identical to SEQ ID NO: 540807
  misc_feature: HIJSMM301EB03O.41.10.A10.1.454.light.4.raw

SEQ ID NO: 544757 - DNA, 507 bp, Homo sapiens
  misc_feature: HIJSMM301DW4A4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaaggaccgaaggtcggaaatacaaacgaacctagtggctgcaccatctgtcttcatcttccccg

SEQ ID NO: 544758 - DNA, 488 bp, Homo sapiens; identical to SEQ ID NO: 537124
  misc_feature: HIJSMM301EKLSW.11.25.C03.1.454.light.4.raw

SEQ ID NO: 544759 - DNA, 498 bp, Homo sapiens
  misc_feature: HIJSMM301AGKGL.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgaatctctggctccagctcaggaaacacagcttccttgaccatcactggggctcaggcggaagatgaggctgactattactgtagctcccgggacaacagtggtaaccatgtggtattcggcggagggaccaaactgaccgtcctaggtcagcccaaggctgccccctcggtcactctgtt

SEQ ID NO: 544760 - DNA, 516 bp, Homo sapiens
  misc_feature: HIJSMM301EBSBG.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcacctctcgttcccaccctcct

SEQ ID NO: 544761 - DNA, 490 bp, Homo sapiens
  misc_feature: HIJSMM301BAE8O.17.49.E05.1.454.light.4.raw
cgtagactagcacgaccggtgctcgatttagagcgactagcaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcagtttattactgtcagcaatataatgactggcctccgctcactttcggcggagggaccaaggtggagatcaaacgaactgtggctgcacca

SEQ ID NO: 544762 - DNA, 502 bp, Homo sapiens
  misc_feature: HIJSMM301DQW2X.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatct

SEQ ID NO: 544763 - DNA, 494 bp, Homo sapiens
  misc_feature: HIJSMM301EB3YM.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttctagacgaactgtggcgtgcaccatctgtcttcta

SEQ ID NO: 544764 - DNA, 555 bp, Homo sapiens
  misc_feature: HIJSMM301BJ9HB.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaaacctccagtctgacgatgaggctgagtatcactgtggagagagccacacaattgatggccaaagacggttggatggttcggcggaggaccaagctggacccgttccgtaggtcacgccccgaaagggtcctccgcccccccgttcgggtaccaccttccttcggttccccccaccccttccccgtcggtcctaacggttaac

SEQ ID NO: 544765 - DNA, 460 bp, Homo sapiens
  misc_feature: HIJSMM301DZDXP.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagaaggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 544766 - DNA, 515 bp, Homo sapiens
  misc_feature: HIJSMM301EV6S3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctccctacttccgttcggacgggacggaacgaggcggaagtacacgacgaacgtaacgtggtcggtcgcgaccaactacttcgtcttcctta

SEQ ID NO: 544767 - DNA, 472 bp, Homo sapiens; identical to SEQ ID NO: 536302
  misc_feature: HIJSMM301B7QLG.18.76.G10.1.454.light.4.raw

SEQ ID NO: 544768 - DNA, 493 bp, Homo sapiens
  misc_feature: HIJSMM301AV5AP.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgtt

SEQ ID NO: 544769 - DNA, 476 bp, Homo sapiens
  misc_feature: HIJSMM301CL3P9.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaaagtggatgtcaaccgaactgtggctgcacc

SEQ ID NO: 544770 - DNA, 514 bp, Homo sapiens
  misc_feature: HIJSMM301DEJAG.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgccctcctcgagtagtaca

SEQ ID NO: 544771 - DNA, 497 bp, Homo sapiens; identical to SEQ ID NO: 536376
  misc_feature: HIJSMM301D6NHG.22.9.A09.1.454.light.4.raw

SEQ ID NO: 544772 - DNA, 481 bp, Homo sapiens; identical to SEQ ID NO: 539249
  misc_feature: HIJSMM301BFXDE.11.76.G10.1.454.light.4.raw

SEQ ID NO: 544773 - DNA, 493 bp, Homo sapiens
  misc_feature: HIJSMM301BDBCT.21.47.E03.1.454.light.4.raw
tcgtcgctcgcacgaccggtgctcgatttagactcgcgcacagagagaagggggcaggagtcagacccagtcaggacacagcatggacatgagggtccccgctcagctcctggggctcctgctgctctggttcccaggttccagatgcgacatccagatgacccagtctccttcttccgtgtctgcatctgtaggagacagagtcaccatcacttgtcgggcgagtcagggtattagcaactggttagcctggtatcagcagaaaccaggaaaagcccctaaactcctgatctatgctgcatccacgttgcaaagtggagtcccgtcaaggttcagcggcagtgggtctgggacggatttcaatctcaccatcaccagcctgcagcctgaagattttgcaacttattattgtcaacaggctaacagttttcctctcacgttcggcggagggaccaacgtggaggtcaaacgaactgtggctgcaccatctgtt

SEQ ID NO: 544774 - DNA, 513 bp, Homo sapiens
  misc_feature: HIJSMM301EE4VU.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagttgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgtaccgtcttaagtcagcccaaggctgccccctcggtcactctgttcccgccctcct

SEQ ID NO: 544775 - DNA, 483 bp, Homo sapiens
  misc_feature: HIJSMM301D1BS7.52.86.H09.1.454.light.4.raw
  modified_base (436)..(436): a, c, t, g, unknown or other
cgcagtacgacacgaccggtgctcgatttagtgctatagacttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtctaggtcagcccaaggctcg

SEQ ID NO: 544776 - DNA, 493 bp, Homo sapiens; identical to SEQ ID NO: 535047
  misc_feature: HIJSMM301ALJNP.16.53.E09.1.454.light.4.raw

SEQ ID NO: 544777 - DNA, 501 bp, Homo sapiens
  misc_feature: HIJSMM301EQGZB.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatcctgaccta

SEQ ID NO: 544778 - DNA, 503 bp, Homo sapiens
  misc_feature: HIJSMM301D3W4P.48.67.G01.1.454.light.4.raw
agtatacatacacgaccggtgctcgatttagagtatacatattgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatccttcccg

SEQ ID NO: 544779 - DNA, 488 bp, Homo sapiens
  misc_feature: HIJSMM301BF6AZ.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaacgaactgtggctgcacatctgtcttcat

SEQ ID NO: 544780 - DNA, 509 bp, Homo sapiens
  misc_feature: HIJSMM301AVD3W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggtccaacgggaccgaacggtaggaaagtacaaacgaactagtggctgcaccatctgtcttcatcttccccg

SEQ ID NO: 544781 - DNA, 501 bp, Homo sapiens
  misc_feature: HIJSMM301BMI38.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctactaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 544782 - DNA, 489 bp, Homo sapiens
  misc_feature: HIJSMM301APY1U.48.26.C04.1.454.light.4.raw
agtatacatacacgaccggtgctcgatttagtctagcgactttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtcggcagaagacgaggctgactactattgtcagtcaggagacaatactcgcacgcaagtactgttcggcggagggaccaagctgacagtcctaggtcagcccaaggctgccccctc

SEQ ID NO: 544783 - DNA, 518 bp, Homo sapiens; identical to SEQ ID NO: 539372
  misc_feature: HIJSMM301AKA3U.7.86.H09.1.454.light.4.raw

SEQ ID NO: 544784 - DNA, 486 bp, Homo sapiens
  misc_feature: HIJSMM301CN2K4.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtggatctgggacagacttcactctcaccatcagcagactggagcctgaggattttgcagtgtattactgtcagcagtatcataggtcaaacaccttcggccaagggacacgactggagattaaaggaactgtggctgcaccatctgtcttcat

SEQ ID NO: 544785 - DNA, 490 bp, Homo sapiens; identical to SEQ ID NO: 544556
  misc_feature: HIJSMM301B9E94.15.3.A03.1.454.light.4.raw

SEQ ID NO: 544786 - DNA, 483 bp, Homo sapiens
  misc_feature: HIJSMM301B3MAB.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaacgaa

SEQ ID NO: 544787 - DNA, 482 bp, Homo sapiens
  misc_feature: HIJSMM301A0C3N.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggccctgggaccacagtagatatcaaacgaactgtggctgcaccatt

SEQ ID NO: 544788 - DNA, 507 bp, Homo sapiens
  misc_feature: HIJSMM301CUUXQ.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcact

SEQ ID NO: 544789 - DNA, 498 bp, Homo sapiens; identical to SEQ ID NO: 535469
  misc_feature: HIJSMM301AJV4V.12.18.B07.1.454.light.4.raw

SEQ ID NO: 544790 - DNA, 486 bp, Homo sapiens
  misc_feature: HIJSMM301BFMC5.26.55.E11.1.454.light.4.raw
agactatactcacgaccggtgctcgatttagcactcgcacgttgggtttgggggcaggagtccagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccagggaccaagctggagatcacaggaactgtggctgcacc

SEQ ID NO: 544791 - DNA, 496 bp, Homo sapiens
  misc_feature: HIJSMM301CVDZG.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaagtcaaacgaactgtggctgcaccatctgtcttcatt

SEQ ID NO: 544792 - DNA, 500 bp, Homo sapiens
  misc_feature: HIJSMM301CVC3P.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttatactgtcagcaatactatagtcctcctctcacgttcggcggagggaccaaggtggagatcaaacgaactgtggctgcaccatctgtctt

SEQ ID NO: 544793 - DNA, 493 bp, Homo sapiens
  misc_feature: HIJSMM301APPD8.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaacgggacgacgactggagattaaacgaactagtggctgcaccatctgtcttcat

SEQ ID NO: 544794 - DNA, 501 bp, Homo sapiens
  misc_feature: HIJSMM301EI9EN.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccgggggaccgaccgtggaaatcaaacgaactgtggctgcacc

SEQ ID NO: 544795 - DNA, 485 bp, Homo sapiens; identical to SEQ ID NO: 539315
  misc_feature: HIJSMM301EHCOQ.3.88.H11.1.454.light.4.raw

SEQ ID NO: 544796 - DNA, 506 bp, Homo sapiens
  misc_feature: HIJSMM301BEITV.48.78.H01.1.454.light.4.raw
agtatacatacacgaccggtgctcgatttagtgtgagtagtttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttactattttattactgtcagcagtatcgtaagtggactccgacgtttggccaagggaccaaggtggaagtcaaacgaactgtggctgcaccatctgtcttcatcttcccgcc

SEQ ID NO: 544797 - DNA, 472 bp, Homo sapiens
  misc_feature: HIJSMM301EELDU.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcactgggaccaaggtcaccgtcctaggtcagacccc

SEQ ID NO: 544798 - DNA, 507 bp, Homo sapiens
  misc_feature: HIJSMM301D1W27.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcacccggacgtcgtcgaggacgaacggaggagtacaacgaactagtggcgtgcaccactctcgtcttctactcttcccgcctact

SEQ ID NO: 544799 - DNA, 510 bp, Homo sapiens
  misc_feature: HIJSMM301EU1LI.51.86.H09.1.454.light.4.raw
cgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggtttattactgcatgcaaggtacacactggcctgggacgttcggccaagggaccaaggtggaaagtacaaacgaactgtggcgtgcaccatctgtctt

SEQ ID NO: 544800 - DNA, 493 bp, Homo sapiens
  misc_feature: HIJSMM301AW2FK.53.81.H04.1.454.light.4.raw
cgcgtatacacacgaccggtgctcgatttagtagtgtagattcgcggggtcagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagccc

SEQ ID NO: 544801 - DNA, 488 bp, Homo sapiens; identical to SEQ ID NO: 540982
  misc_feature: HIJSMM301AEH97.8.4.A04.1.454.light.4.raw

SEQ ID NO: 544802 - DNA, 502 bp, Homo sapiens; identical to SEQ ID NO: 543695
  misc_feature: HIJSMM301BPI7K.19.78.H01.1.454.light.4.raw

SEQ ID NO: 544803 - DNA, 491 bp, Homo sapiens
  misc_feature: HIJSMM301CLUQD.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcctgatgattttgcaacttattactgccaacattacaatgattactcgcgtacgttcggccaagggaccagggtggaaatcaaacgaactgtggctgcaccatctgtcttcta

SEQ ID NO: 544804 - DNA, 375 bp, Homo sapiens
  misc_feature: HIJSMM301C87MZ.40.9.A09.1.454.light.4.raw
tctagcgactcacgaccggtgctcgatttagcgagacgcgcagggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 544805 - DNA, 496 bp, Homo sapiens
  misc_feature: HIJSMM301CROO8.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgtttcggcggagggaccaagctgaccgtcctaggtcagcccaaggctgccccctcggtcactctgttcccacctcct

SEQ ID NO: 544806 - DNA, 509 bp, Homo sapiens
  misc_feature: HIJSMM301AKB4L.17.87.H10.1.454.light.4.raw
cgtagactagcacgaccggtgctcgatttagcagtactgcgttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggtcggaggcaccaaggtgaccgtcctaggtcagcccaaggctgccccctcggtcta

SEQ ID NO: 544807 - DNA, 489 bp, Homo sapiens; identical to SEQ ID NO: 536013
  misc_feature: HIJSMM301A9HZB.26.23.C01.1.454.light.4.raw

SEQ ID NO: 544808 - DNA, 503 bp, Homo sapiens
  misc_feature: HIJSMM301DF7DZ.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaataagaggtcaaacgaactgtggctgcaccatctgtcttcatt

SEQ ID NO: 544809 - DNA, 497 bp, Homo sapiens
  misc_feature: HIJSMM301A3Y19.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtcttcatcttcccgcatctgacta

SEQ ID NO: 544810 - DNA, 492 bp, Homo sapiens
  misc_feature: HIJSMM301B4L3M.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttca

SEQ ID NO: 544811 - DNA, 497 bp, Homo sapiens; identical to SEQ ID NO: 536371
  misc_feature: HIJSMM301B5CQ5.16.78.H01.1.454.light.4.raw

SEQ ID NO: 544812 - DNA, 377 bp, Homo sapiens; identical to SEQ ID NO: 536071
  misc_feature: HIJSMM301AQKP0.40.9.A09.1.454.light.4.raw

SEQ ID NO: 544813 - DNA, 486 bp, Homo sapiens; identical to SEQ ID NO: 535385
  misc_feature: HIJSMM301BTB64.19.71.G05.1.454.light.4.raw

SEQ ID NO: 544814 - DNA, 506 bp, Homo sapiens; identical to SEQ ID NO: 536355
  misc_feature: HIJSMM301BTMEJ.47.85.H08.1.454.light.4.raw

SEQ ID NO: 544815 - DNA, 510 bp, Homo sapiens
  misc_feature: HIJSMM301DW9FG.17.41.D08.1.454.light.4.raw
cgtagactagcacgaccggtgctcgatttagtcacgcgagaaagggaaaggggagagaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccg

SEQ ID NO: 544816 - DNA, 496 bp, Homo sapiens; identical to SEQ ID NO: 538149
  misc_feature: HIJSMM301AMLBZ.13.67.G01.1.454.light.4.raw

SEQ ID NO: 544817 - DNA, 504 bp, Homo sapiens
  misc_feature: HIJSMM301AJ2VO.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggacttggcccaaggaccaaggtggaattcaaccgaactgtggctgcaccatctgtcttcatcttcccg

SEQ ID NO: 544818 - DNA, 485 bp, Homo sapiens
  misc_feature: HIJSMM301AU79K.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaa

SEQ ID NO: 544819 - DNA, 489 bp, Homo sapiens
  misc_feature: HIJSMM301AR7XC.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggaggatcaaacgaa

SEQ ID NO: 544820 - DNA, 510 bp, Homo sapiens
  misc_feature: HIJSMM301CEROL.48.59.F04.1.454.light.4.raw
agtatacatacacgaccggtgctcgatttagtacacacacttagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccccg

SEQ ID NO: 544821 - DNA, 484 bp, Homo sapiens
  misc_feature: HIJSMM301B4PZ2.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttaattggacgttcggccaggggaccaaggtcgaaatgagacgaactgtggctgcacatctgtctt

SEQ ID NO: 544822 - DNA, 494 bp, Homo sapiens; identical to SEQ ID NO: 535276
  misc_feature: HIJSMM301BNZOV.16.6.A06.1.454.light.4.raw

SEQ ID NO: 544823 - DNA, 502 bp, Homo sapiens
  misc_feature: HIJSMM301D8A6C.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgttcttcggaattgggacgacggtcaccgtcctaggtcagcccaaggccaacccca

SEQ ID NO: 544824 - DNA, 495 bp, Homo sapiens
  misc_feature: HIJSMM301BFDFM.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggagtggatctgggacagattttactctcggcatccgcagcctgcagcctgaagattttgcgacatattactgtcaacagtatgaaaatgtcccgctcactttcggcgggggaccgaaggtggagttcaaacgaactagtggctgcaccatctgtcttcatt

SEQ ID NO: 544825 - DNA, 494 bp, Homo sapiens; identical to SEQ ID NO: 534994
  misc_feature: HIJSMM301A5FN0.27.78.H01.1.454.light.4.raw

SEQ ID NO: 544826 - DNA, 484 bp, Homo sapiens; identical to SEQ ID NO: 535211
  misc_feature: HIJSMM301D5UEC.47.46.E02.1.454.light.4.raw

SEQ ID NO: 544827 - DNA, 488 bp, Homo sapiens; identical to SEQ ID NO: 540982
  misc_feature: HIJSMM301AZR2P.8.4.A04.1.454.light.4.raw

SEQ ID NO: 544828 - DNA, 520 bp, Homo sapiens; identical to SEQ ID NO: 537173
  misc_feature: HIJSMM301BEJSD.27.23.C01.1.454.light.4.raw

SEQ ID NO: 544829 - DNA, 444 bp, Homo sapiens; identical to SEQ ID NO: 541457
  misc_feature: HIJSMM301CGA2K.7.18.B07.1.454.light.4.raw

SEQ ID NO: 544830 - DNA, 512 bp, Homo sapiens; identical to SEQ ID NO: 539198
  misc_feature: HIJSMM301DPWYB.17.33.C11.1.454.light.4.raw

SEQ ID NO: 544831 - DNA, 499 bp, Homo sapiens
  misc_feature: HIJSMM301ERYZA.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctccg

SEQ ID NO: 544832 - DNA, 504 bp, Homo sapiens; identical to SEQ ID NO: 539091
  misc_feature: HIJSMM301BUFMF.8.28.C06.1.454.light.4.raw

SEQ ID NO: 544833 - DNA, 485 bp, Homo sapiens; identical to SEQ ID NO: 536263
  misc_feature: HIJSMM301AYCIL.47.78.H01.1.454.light.4.raw

SEQ ID NO: 544834 - DNA, 490 bp, Homo sapiens
  misc_feature: HIJSMM301CEYDQ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgctaatttattactgtcagcaatataatacctggcctccgctcactttcggcggagggaccaaggttgagatacaaacgaactgtggctgcacca

SEQ ID NO: 544835 - DNA, 493 bp, Homo sapiens
  misc_feature: HIJSMM301EFIG1.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactgtggctgcaccatctgtcttcta

SEQ ID NO: 544836 - DNA, 511 bp, Homo sapiens; identical to SEQ ID NO: 535406
  misc_feature: HIJSMM301B1Y5G.43.59.F04.1.454.light.4.raw

SEQ ID NO: 544837 - DNA, 498 bp, Homo sapiens
  misc_feature: HIJSMM301BKAV0.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 544838 - DNA, 490 bp, Homo sapiens
  misc_feature: HIJSMM301A6N64.14.55.E11.1.454.light.4.raw
  modified_base (453)..(453): a, c, t, g, unknown or other
  modified_base (455)..(455): a, c, t, g, unknown or other
  modified_base (469)..(469): a, c, t, g, unknown or other
  modified_base (480)..(480): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcctactcgtcggaggacgacgaggagancnacgacgtatggcgngtcgaccactntcgtcttcta

SEQ ID NO: 544839 - DNA, 513 bp, Homo sapiens
  misc_feature: HIJSMM301AGAFE.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctcctagcgttcggtccacggggacggaacggtagggaaggtacgtaagacggaactacgtaggcgtcgtcaccactactcgttcc

SEQ ID NO: 544840 - DNA, 488 bp, Homo sapiens; identical to SEQ ID NO: 535725
  misc_feature: HIJSMM301A9480.12.88.H11.1.454.light.4.raw

SEQ ID NO: 544841 - DNA, 499 bp, Homo sapiens
  misc_feature: HIJSMM301BBF82.19.10.A10.1.454.light.4.raw
tactctcgtgcacgaccggtgctcgatttagcgtcgatctcagggggaagagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatt

SEQ ID NO: 544842 - DNA, 519 bp, Homo sapiens; identical to SEQ ID NO: 542078
  misc_feature: HIJSMM301BB773.5.27.C05.1.454.light.4.raw

SEQ ID NO: 544843 - DNA, 477 bp, Homo sapiens; identical to SEQ ID NO: 535122
  misc_feature: HIJSMM301C9QDC.26.72.G06.1.454.light.4.raw

SEQ ID NO: 544844 - DNA, 530 bp, Homo sapiens
  misc_feature: HIJSMM301ETIFC.52.70.G04.1.454.light.4.raw
cgcagtacgacacgaccggtgctcgatttagtgtagtgtgaagggaaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccaccctcctctataccga

SEQ ID NO: 544845 - DNA, 487 bp, Homo sapiens; identical to SEQ ID NO: 537079
  misc_feature: HIJSMM301CKB22.14.55.E11.1.454.light.4.raw

SEQ ID NO: 544846 - DNA, 496 bp, Homo sapiens
  misc_feature: HIJSMM301DFN97.12.37.D04.1.454.light.4.raw
atacgacgtacacgaccggtgctcgatttagtagcatactgttgggtttggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 544847 - DNA, 496 bp, Homo sapiens; identical to SEQ ID NO: 537925
  misc_feature: HIJSMM301A4MIO.22.14.B03.1.454.light.4.raw

SEQ ID NO: 544848 - DNA, 532 bp, Homo sapiens
  misc_feature: HIJSMM301AFLWT.7.87.H10.1.454.light.4.raw
cgtgtctctacacgaccggtgctcgatttagcagtactgcgttggggtttgggggagctgctcagttaggacccagagggaaccatggaaaccccagcgcagcttctcttcctcctgctactctggctcccagataccaccggagaaactgtgttgacacagtctccaggcaccctgtctttgtctccggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaagtacgaaacgaacgtagtaggcgtgcaccactactcgtcttcctactcttcccgtccctactctcgta

SEQ ID NO: 544849 - DNA, 485 bp, Homo sapiens; identical to SEQ ID NO: 535688
  misc_feature: HIJSMM301D5P3E.19.5.A05.1.454.light.4.raw

SEQ ID NO: 544850 - DNA, 515 bp, Homo sapiens
  misc_feature: HIJSMM301BHXHE.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccgccctcctc

SEQ ID NO: 544851 - DNA, 485 bp, Homo sapiens; identical to SEQ ID NO: 536307
  misc_feature: HIJSMM301BYITN.46.35.D02.1.454.light.4.raw

SEQ ID NO: 544852 - DNA, 517 bp, Homo sapiens
  misc_feature: HIJSMM301DKFAJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccgaacggaccgaacggtaggaagtacaaacgaactagtggcgtgcaccactctgtcttctactcttcccgtcctact

SEQ ID NO: 544853 - DNA, 448 bp, Homo sapiens
  misc_feature: HIJSMM301B6RRZ.9.9.A09.1.454.light.4.raw
tgatacgtctcacgaccggtgctcgatttagcgagacgcgcagggtcctgggcccagtctgtgctgacgcagtcgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctcgccccctcggtccactctcgttccccaccctcctcagacgtatca

SEQ ID NO: 544854 - DNA, 447 bp, Homo sapiens; identical to SEQ ID NO: 535020
  misc_feature: HIJSMM301CQSXC.18.9.A09.1.454.light.4.raw

SEQ ID NO: 544855 - DNA, 498 bp, Homo sapiens
  misc_feature: HIJSMM301BTF0Z.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 544856 - DNA, 496 bp, Homo sapiens
  misc_feature: HIJSMM301EIOIF.51.83.H06.1.454.light.4.raw
cgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaaactgtggctgcaccatctgtcttctat

SEQ ID NO: 544857 - DNA, 511 bp, Homo sapiens
  misc_feature: HIJSMM301C5JQY.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgt

SEQ ID NO: 544858 - DNA, 384 bp, Homo sapiens
  misc_feature: HIJSMM301AIBBJ.41.26.C04.1.454.light.4.raw
tctatactatcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggccggagggaccaaggtggagatcaaacgaactgtggctgcaccatctgtcttcatcttcccgccatctgaatagtataga

SEQ ID NO: 544859 - DNA, 504 bp, Homo sapiens
  misc_feature: HIJSMM301BXZNA.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccaccct

SEQ ID NO: 544860 - DNA, 490 bp, Homo sapiens; identical to SEQ ID NO: 535936
  misc_feature: HIJSMM301CKRIS.16.68.G02.1.454.light.4.raw

SEQ ID NO: 544861 - DNA, 505 bp, Homo sapiens; identical to SEQ ID NO: 535503
  misc_feature: HIJSMM301C4IBA.8.28.C06.1.454.light.4.raw

SEQ ID NO: 544862 - DNA, 488 bp, Homo sapiens
  misc_feature: HIJSMM301BHV6L.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggtattttgctagtttattactgtcagcattacaataactggcctcggctcactttcggcggagggaccaaggtggagatcaaacgaactgtggctgcaccat

SEQ ID NO: 544863 - DNA, 497 bp, Homo sapiens; identical to SEQ ID NO: 536371
  misc_feature: HIJSMM301AVQ95.16.78.H01.1.454.light.4.raw

SEQ ID NO: 544864 - DNA, 314 bp, Homo sapiens
  misc_feature: HIJSMM301D06EA.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagat

SEQ ID NO: 544865 - DNA, 487 bp, Homo sapiens
  misc_feature: HIJSMM301AFXLR.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaaggaccaaggtaggaaatacaaacgaactagtggctcgcaccta

SEQ ID NO: 544866 - DNA, 514 bp, Homo sapiens; identical to SEQ ID NO: 543100
  misc_feature: HIJSMM301CGEK2.8.23.C01.1.454.light.4.raw

SEQ ID NO: 544867 - DNA, 481 bp, Homo sapiens
  misc_feature: HIJSMM301AF4FC.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgccaacaatataataattattggacgttcggccagggaccgaaggtcgaaatagagacgaactagtggctgcaccatctgtt

SEQ ID NO: 544868 - DNA, 484 bp, Homo sapiens; identical to SEQ ID NO: 535211
  misc_feature: HIJSMM301E1EG9.47.46.E02.1.454.light.4.raw

SEQ ID NO: 544869 - DNA, 350 bp, Homo sapiens; identical to SEQ ID NO: 537421
  misc_feature: HIJSMM301DC16L.13.11.A11.1.454.light.4.raw

SEQ ID NO: 544870 - DNA, 470 bp, Homo sapiens
  misc_feature: HIJSMM301D8XBQ.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgtcctgagtcagccc

SEQ ID NO: 544871 - DNA, 524 bp, Homo sapiens
  misc_feature: HIJSMM301EYAI8.14.57.F02.1.454.light.4.raw
  modified_base (489)..(489): a, c, t, g, unknown or other
  modified_base (499)..(499): a, c, t, g, unknown or other
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggaccggaacggtaggtggtactaaccgaaacgtcgtggtcgtcncgaccaactnttcgttcgtccttactccttcccgt

SEQ ID NO: 544872 - DNA, 506 bp, Homo sapiens
  misc_feature: HIJSMM301C7T6Y.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtca

SEQ ID NO: 544873 - DNA, 489 bp, Homo sapiens; identical to SEQ ID NO: 537328
  misc_feature: HIJSMM301ATPJ0.13.5.A05.1.454.light.4.raw

SEQ ID NO: 544874 - DNA, 507 bp, Homo sapiens
  misc_feature: HIJSMM301BHSZU.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcggcggagggaccaagctgaccgtcctaagtcagcccaaggctgccccctcgtcactctcg

SEQ ID NO: 544875 - DNA, 488 bp, Homo sapiens
  misc_feature: HIJSMM301BW0SD.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaaggaccaaggtggaaatcaaacgaactagtggctgcaccat

SEQ ID NO: 544876 - DNA, 494 bp, Homo sapiens; identical to SEQ ID NO: 535184
  misc_feature: HIJSMM301BI8EY.16.71.G05.1.454.light.4.raw

SEQ ID NO: 544877 - DNA, 485 bp, Homo sapiens; identical to SEQ ID NO: 535653
  misc_feature: HIJSMM301ENRLM.47.62.F07.1.454.light.4.raw

SEQ ID NO: 544878 - DNA, 509 bp, Homo sapiens
  misc_feature: HIJSMM301E26UT.49.76.G10.1.454.light.4.raw
  modified_base (406)..(406): a, c, t, g, unknown or other
agtcgagagacacgaccggtgctcgatttagtcactcatacagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcatttcctactatttaaattggtatcaacaaagacccgggaaagcccctaggctcctgatctatgctgcatccaatttgcaaagtggggtcccatcaaggttcagtgccagtggatctgggacagacttcaccctcaccatcgacagtctgcaacctgagattttgcaacttacttctgtcaacanagtttcgcttcccctacctacttgttccgacgggacggacgaactcggcggatctaaacgaaacgtaacgttggtcgtcgtcaccaactcttcgttcttctta

SEQ ID NO: 544879 - DNA, 454 bp, Homo sapiens; identical to SEQ ID NO: 536347
  misc_feature: HIJSMM301D4PUX.19.86.H09.1.454.light.4.raw

SEQ ID NO: 544880 - DNA, 492 bp, Homo sapiens
  misc_feature: HIJSMM301EU274.8.80.H03.1.454.light.4.raw
ctcgcgtgtccacgaccggtgctcgatttagctgtgcgtcgaagggaaagggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctacttagcctggtatcagcagaaaccagggaaagcccctaacctcctgatccatactgcatccagcttgcaaagtggggtcccatcaaggttcagcggcagtggatctgggacagatttcactctcaccatcagcagcctgcagcctgaagattttgcaacttactattgtcaacaggctgccggtttcccttggacgttcggccaaggaccgaaaggtaggaaagtacaaacgaaactagtggctgcaccaactct

SEQ ID NO: 544881 - DNA, 503 bp, Homo sapiens
  misc_feature: HIJSMM301DF1XB.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcacatctgtcttcattccttccccgactctctgaccta

SEQ ID NO: 544882 - DNA, 444 bp, Homo sapiens; identical to SEQ ID NO: 535594
  misc_feature: HIJSMM301CJ9RV.9.9.A09.1.454.light.4.raw

SEQ ID NO: 544883 - DNA, 488 bp, Homo sapiens; identical to SEQ ID NO: 539612
  misc_feature: HIJSMM301E0DQ4.3.55.E11.1.454.light.4.raw

SEQ ID NO: 544884 - DNA, 491 bp, Homo sapiens
  misc_feature: HIJSMM301EK780.26.78.H01.1.454.light.4.raw
agactatactcacgaccggtgctcgatttagtgtgagtagtttgggtttggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggatcagacgaactgtggctggcaccatctgt

SEQ ID NO: 544885 - DNA, 498 bp, Homo sapiens
  misc_feature: HIJSMM301C4UTQ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctcggtcactctccg

SEQ ID NO: 544886 - DNA, 358 bp, Homo sapiens
  misc_feature: HIJSMM301AYGCQ.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcaggggtccctgatcgcttctctgcctccaagtctggcaacacggcctccctgaccatctctgggctccagggtgaggacgaggctgattattactgcagctcatttacaagcagcaccactcaggtcttcggaactgggactaaggtcaccgtcctaggtcagcccaaggccaaccccactgtcactctgttcccaccctcctcgagtgcgtct

SEQ ID NO: 544887 - DNA, 447 bp, Homo sapiens; identical to SEQ ID NO: 535020
  misc_feature: HIJSMM301BL6XE.18.9.A09.1.454.light.4.raw

SEQ ID NO: 544888 - DNA, 487 bp, Homo sapiens
  misc_feature: HIJSMM301DGKAK.26.12.B01.1.454.light.4.raw
  modified_base (401)..(401): a, c, t, g, unknown or other
agactatactcacgaccggtgctcgatttagtagtgtagattccgcggggagagctctggggaggaactgctcagtcaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtactcccagcccaggttcagtggcagtgggtctgggacagagttcactctcaccatcagcagcctgcagtctgaagnttgtgcaattttattactgtcagcaatataatacctggcctccgctcactttcggcggaggaccaaggttgagatacaaacgaact

SEQ ID NO: 544889 - DNA, 495 bp, Homo sapiens
  misc_feature: HIJSMM301A4EPO.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcgtggtctcccccttagtttcggcggagggaccaaggttgagatcaaacgaactgtggctgcaccatctgtcttcatcttccccg

SEQ ID NO: 544890 - DNA, 361 bp, Homo sapiens
  misc_feature: HIJSMM301BERZL.3.57.F02.1.454.light.4.raw
agacgcactccacgaccggtgctcgatttagctcgatatagttgggtttgggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccgccctcctcgagtgcgtct

SEQ ID NO: 544891 - DNA, 513 bp, Homo sapiens
  misc_feature: HIJSMM301A5O22.21.22.B11.1.454.light.4.raw
tcgtcgctcgcacgaccggtgctcgatttagacgacagctcagggtgggggtcaaaaacccgggggagggggtctgatttgcatggatggactctccccctcctcagagtacgaagagagggagagatctggggaaggctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccccaaactcctcatccagaggaataatcagcggccctccaggggtccctcgaccgattctctggctccaagtctggcacctcagcctccctgaccatcagtgggctcccggtccgaggatgaggctgactattact

SEQ ID NO: 544892 - DNA, 501 bp, Homo sapiens
  misc_feature: HIJSMM301AKHK4.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccgaaggtggagttcaaacgaactgtggctgcaccatctgtcttcatcttcccgcc

SEQ ID NO: 544893 - DNA, 473 bp, Homo sapiens
  misc_feature: HIJSMM301BRM9M.52.59.F04.1.454.light.4.raw
  modified_base (430)..(430): a, c, t, g, unknown or other
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctnacacgttcggccaagggccaagctggaaatcaaacgactgtgg

SEQ ID NO: 544894 - DNA, 479 bp, Homo sapiens; identical to SEQ ID NO: 535586
  misc_feature: HIJSMM301D80UQ.13.34.D01.1.454.light.4.raw

SEQ ID NO: 544895 - DNA, 518 bp, Homo sapiens
  misc_feature: HIJSMM301CMC96.43.81.H04.1.454.light.4.raw
  modified_base (452)..(452): a, c, t, g, unknown or other
  modified_base (496)..(496): a, c, t, g, unknown or other
tgtgagtagtcacgaccggtgctcgatttagtagtgtagattcgcggggctggcgccgaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtctgcctggtcttcggcgggggacgtcngttgaccgtcctacggtcagcccaacgcgtcgccccctcggtcnctctgttcccgccctcctcact

SEQ ID NO: 544896 - DNA, 454 bp, Homo sapiens; identical to SEQ ID NO: 536943
  misc_feature: HIJSMM301A65KK.19.86.H09.1.454.light.4.raw

SEQ ID NO: 544897 - DNA, 487 bp, Homo sapiens
  misc_feature: HIJSMM301D9VWV.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactagtggctgcaccat

SEQ ID NO: 544898 - DNA, 516 bp, Homo sapiens
  misc_feature: HIJSMM301AOJUJ.48.37.D04.1.454.light.4.raw
agtatacatacacgaccggtgctcgatttagtagcatactgttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtctac

SEQ ID NO: 544899 - DNA, 514 bp, Homo sapiens; identical to SEQ ID NO: 541418
  misc_feature: HIJSMM301ANTI9.17.33.C11.1.454.light.4.raw

SEQ ID NO: 544900 - DNA, 492 bp, Homo sapiens; identical to SEQ ID NO: 534967
  misc_feature: HIJSMM301D4LPF.47.64.F09.1.454.light.4.raw

SEQ ID NO: 544901 - DNA, 503 bp, Homo sapiens; identical to SEQ ID NO: 536834
  misc_feature: HIJSMM301EX29T.2.35.D02.1.454.light.4.raw

SEQ ID NO: 544902 - DNA, 480 bp, Homo sapiens
  misc_feature: HIJSMM301APMSP.5.23.C01.1.454.light.4.raw
atcagacacgcacgaccggtgctcgatttagtacacgtgattagggattgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagagttcactctcaccatcagcagcctgcagcctgatgatcttggaacttattactgccaacaatataatagttattggacgttcggccagggaccgaaggtcgaaatagagacgaactgtggctgcacca

SEQ ID NO: 544903 - DNA, 487 bp, Homo sapiens; identical to SEQ ID NO: 536196
  misc_feature: HIJSMM301AJ43B.11.28.C06.1.454.light.4.raw

SEQ ID NO: 544904 - DNA, 509 bp, Homo sapiens
  misc_feature: HIJSMM301DK0E8.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccggtggaaataaacgaactgtggctgcaccatctgtcttcta

SEQ ID NO: 544905 - DNA, 510 bp, Homo sapiens
  misc_feature: HIJSMM301C3B9M.40.26.C04.1.454.light.4.raw
tctagcgactcacgaccggtgctcgatttagtctagcgactttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcaccagcgtagcagctggcctcgaacgttgccaaggaccgaaggtaggacgatcaagacgaactgtggcgtgcaccatctgtcttctatcttccccg

SEQ ID NO: 544906 - DNA, 507 bp, Homo sapiens; identical to SEQ ID NO: 535930
  misc_feature: HIJSMM301AJZJF.15.34.D01.1.454.light.4.raw

SEQ ID NO: 544907 - DNA, 453 bp, Homo sapiens
  misc_feature: HIJSMM301BKNA9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 544908 - DNA, 492 bp, Homo sapiens
  misc_feature: HIJSMM301BGGSX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaggtggaggtcaaacgaactgtggctgcaccatctgtcttcatt

SEQ ID NO: 544909 - DNA, 494 bp, Homo sapiens
  misc_feature: HIJSMM301BK5N7.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggcccaacccactgtca

SEQ ID NO: 544910 - DNA, 478 bp, Homo sapiens; identical to SEQ ID NO: 543315
  misc_feature: HIJSMM301AUVVZ.26.72.G06.1.454.light.4.raw

SEQ ID NO: 544911 - DNA, 484 bp, Homo sapiens
  misc_feature: HIJSMM301EN1RD.3.77.G11.1.454.light.4.raw
agacgcactccacgaccggtgctcgatttagctagtcactcaagggaaaggggaggaactgctcagttaggacccagacggaaccatggaagccccagcgcagcttctcttcctcctgctactctggctcccagataccactgcacaaatagtgatgacgcagtctccagccaccctgtctgtttctccaggggaaacagtctccctctcctgcagggccagtcagagtgtcaacaacaacttagcctggtatcaacagaaacctggccaggctcccaggctcctcatctatgatgtgtcttctcgggtcactggtctcccaggcaggttcagtggcagtggatctgggacagaattcacgctcaccatcatcaggctgcggtctgacgacttcgcagtctatttctgtcaacagtacgatggccggctccgtggacattcggccaaggtaccaaggtggacatcagacgaactgtgctgcacc

SEQ ID NO: 544912 - DNA, 521 bp, Homo sapiens
  misc_feature: HIJSMM301DVNFG.12.21.B10.1.454.light.4.raw
atacgacgtacacgaccggtgctcgatttagtgtcgtcgcaagagaggaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaactaccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctggtcactctgttcccaccct

SEQ ID NO: 544913 - DNA, 443 bp, Homo sapiens
  misc_feature: HIJSMM301CY2PA.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtctaagtcagcccaaggctgccccctcggtcactctgttcccgccctcctccgtgtctgat

SEQ ID NO: 544914 - DNA, 484 bp, Homo sapiens; identical to SEQ ID NO: 535400
  misc_feature: HIJSMM301DF2YX.46.26.C04.1.454.light.4.raw

SEQ ID NO: 544915 - DNA, 499 bp, Homo sapiens
  misc_feature: HIJSMM301DYLR9.40.62.F07.1.454.light.4.raw
tctagcgactcacgaccggtgctcgatttagtagtcgcataaagggaaagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacggtggaaagtacaaacgaacctagtggctgcaccaactctgtcttt

SEQ ID NO: 544916 - DNA, 504 bp, Homo sapiens; identical to SEQ ID NO: 540350
  misc_feature: HIJSMM301C71FE.13.81.H04.1.454.light.4.raw

SEQ ID NO: 544917 - DNA, 478 bp, Homo sapiens; identical to SEQ ID NO: 543315
  misc_feature: HIJSMM301A7TCD.26.72.G06.1.454.light.4.raw

SEQ ID NO: 544918 - DNA, 506 bp, Homo sapiens
  misc_feature: HIJSMM301A9DAB.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctcgttcccaccct

SEQ ID NO: 544919 - DNA, 486 bp, Homo sapiens
  misc_feature: HIJSMM301DF0NG.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagcccc

SEQ ID NO: 544920 - DNA, 509 bp, Homo sapiens
  misc_feature: HIJSMM301EK12F.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggccctcgggaccgaaacgtaggatatcaaacgaaactgtggctgcaccatctgt

SEQ ID NO: 544921 - DNA, 494 bp, Homo sapiens
  misc_feature: HIJSMM301C4D15.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtagatcacctcgtccaaggacgacgactgaggataagtaaactagtggcgtgcaccatctgtctt

SEQ ID NO: 544922 - DNA, 476 bp, Homo sapiens
  misc_feature: HIJSMM301ECE12.48.78.H01.1.454.light.4.raw
agtatacatacacgaccggtgctcgatttagtgtgagtagtttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagccc

SEQ ID NO: 544923 - DNA, 447 bp, Homo sapiens; identical to SEQ ID NO: 535201
  misc_feature: HIJSMM301EVDLX.18.9.A09.1.454.light.4.raw

SEQ ID NO: 544924 - DNA, 486 bp, Homo sapiens; identical to SEQ ID NO: 535523
  misc_feature: HIJSMM301D9DOG.22.73.G07.1.454.light.4.raw

SEQ ID NO: 544925 - DNA, 460 bp, Homo sapiens; identical to SEQ ID NO: 536053
  misc_feature: HIJSMM301AF92O.22.28.C06.1.454.light.4.raw

SEQ ID NO: 544926 - DNA, 483 bp, Homo sapiens
  misc_feature: HIJSMM301D9EVC.52.34.D01.1.454.light.4.raw
cgcagtacgacacgaccggtgctcgatttagatcgtctgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctactcaccatctccagcctccagtctgaggacgagggtgactattactgtcagacgtgggacactggcatttgggtgttcggcggagggaccaaggttgaccgtcctaggtcagcccaaggctcg

SEQ ID NO: 544927 - DNA, 495 bp, Homo sapiens
  misc_feature: HIJSMM301D4PBQ.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaa

SEQ ID NO: 544928 - DNA, 505 bp, Homo sapiens
  misc_feature: HIJSMM301A6JJ3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaaggaccgaaggtggaaatacaaacgaactagtggcgtgcaccatctgtcttctatcttccccg

SEQ ID NO: 544929 - DNA, 492 bp, Homo sapiens
  misc_feature: HIJSMM301CBPMA.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagtggcctgcagtctgaagattttgcagtttattactgtcagcagtataatgactgggttttattctactttcggccctgggaccaagtggatttcagacgaactgtggctgcaccatctgtcttcta

SEQ ID NO: 544930 - DNA, 503 bp, Homo sapiens
  misc_feature: HIJSMM301CRBVQ.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacatattatatactccgccgacgttcggccgggggaccaacgtggaaatcaaacgaactgtggctgcaccatctgtt

SEQ ID NO: 544931 - DNA, 463 bp, Homo sapiens; identical to SEQ ID NO: 535008
  misc_feature: HIJSMM301DO4OY.10.9.A09.1.454.light.4.raw

SEQ ID NO: 544932 - DNA, 505 bp, Homo sapiens; identical to SEQ ID NO: 539433
  misc_feature: HIJSMM301EY8W9.2.35.D02.1.454.light.4.raw

SEQ ID NO: 544933 - DNA, 517 bp, Homo sapiens; identical to SEQ ID NO: 541596
  misc_feature: HIJSMM301B1GEA.19.80.H03.1.454.light.4.raw

SEQ ID NO: 544934 - DNA, 516 bp, Homo sapiens
  misc_feature: HIJSMM301C5WJW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaaggtacgaaacgaactagtggcgtgcaccatctgtcttcatcttcccgctat

SEQ ID NO: 544935 - DNA, 474 bp, Homo sapiens; identical to SEQ ID NO: 544751
  misc_feature: HIJSMM301AOZVO.3.38.D05.1.454.light.4.raw

SEQ ID NO: 544936 - DNA, 443 bp, Homo sapiens
  misc_feature: HIJSMM301B2UTW.2.76.G10.1.454.light.4.raw
acgctcgacacacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 544937 - DNA, 506 bp, Homo sapiens; identical to SEQ ID NO: 539303
  misc_feature: HIJSMM301ESHYG.8.19.B08.1.454.light.4.raw

SEQ ID NO: 544938 - DNA, 520 bp, Homo sapiens
  misc_feature: HIJSMM301E1ON0.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtcggaaagtaaaacgaactagtggctgcaccaatctgtcttcatcttccccg

SEQ ID NO: 544939 - DNA, 475 bp, Homo sapiens; identical to SEQ ID NO: 537714
  misc_feature: HIJSMM301DH6SJ.7.81.H04.1.454.light.4.raw

SEQ ID NO: 544940 - DNA, 502 bp, Homo sapiens
  misc_feature: HIJSMM301D67QL.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgcccccc

SEQ ID NO: 544941 - DNA, 460 bp, Homo sapiens
  misc_feature: HIJSMM301BF4RI.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgtcttcatcttcccgccatctgaagtatagtct

SEQ ID NO: 544942 - DNA, 492 bp, Homo sapiens; identical to SEQ ID NO: 539630
  misc_feature: HIJSMM301A3HNK.22.25.C03.1.454.light.4.raw

SEQ ID NO: 544943 - DNA, 484 bp, Homo sapiens; identical to SEQ ID NO: 536395
  misc_feature: HIJSMM301ENM3W.46.35.D02.1.454.light.4.raw

SEQ ID NO: 544944 - DNA, 492 bp, Homo sapiens
  misc_feature: HIJSMM301D5ZQ6.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcaacagcgtaccacaggattcactttcggccctgggaccagagtggatatcaaacgaactgtggctgcaccatctgtcttcta

SEQ ID NO: 544945 - DNA, 486 bp, Homo sapiens; identical to SEQ ID NO: 535043
  misc_feature: HIJSMM301BZ807.46.35.D02.1.454.light.4.raw

SEQ ID NO: 544946 - DNA, 501 bp, Homo sapiens
  misc_feature: HIJSMM301EOBK6.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccaggatgaggctgattattactgtgcaggatgggatgacaacctgggtgcttatctcttcggacctgggaccaaggtcaccgtcttggt

SEQ ID NO: 544947 - DNA, 516 bp, Homo sapiens
  misc_feature: HIJSMM301CLN6Z.48.61.F06.1.454.light.4.raw
agtatacatacacgaccggtgctcgatttagctacgctctaagggaaagggggctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgtttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgccccctcggtcactctgttcccaccctcct

SEQ ID NO: 544948 - DNA, 513 bp, Homo sapiens; identical to SEQ ID NO: 535719
  misc_feature: HIJSMM301BUKW5.17.33.C11.1.454.light.4.raw

SEQ ID NO: 544949 - DNA, 475 bp, Homo sapiens
  misc_feature: HIJSMM301AL4FB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagtattttaatttcaccatcagcagcctccaacgtgatgatgttgcaacatactattgtcagcaatatgtatttgctcctcgagtgcctacgtttcgggcggggaccgaaggtgacatacaaacgaac

SEQ ID NO: 544950 - DNA, 485 bp, Homo sapiens
  misc_feature: HIJSMM301CUA30.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaacgaactgtggctgcaccatctgtctt

SEQ ID NO: 544951 - DNA, 484 bp, Homo sapiens
  misc_feature: HIJSMM301D2D07.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagatctgcaacttattactgtctccagtatgatgcttaccctcggactttcggtccaagggaccaaggtggaaatacaaacgaactagtggctgcacca

SEQ ID NO: 544952 - DNA, 507 bp, Homo sapiens
  misc_feature: HIJSMM301BQYPP.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatggatgacagcctgaatggtccggtattcggcggagggaccaagctgaccgtcctcggtcagcccaaggctgccccctc

SEQ ID NO: 544953 - DNA, 489 bp, Homo sapiens
  misc_feature: HIJSMM301EMRLG.51.83.H06.1.454.light.4.raw
cgatcgtatacacgaccggtgctcgatttagatcacgtgcgtcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccact

SEQ ID NO: 544954 - DNA, 494 bp, Homo sapiens
  misc_feature: HIJSMM301EFO95.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggcccctgggaccaaagtggagatcaaacgaactgtggc

SEQ ID NO: 544955 - DNA, 493 bp, Homo sapiens
  misc_feature: HIJSMM301DB6QG.21.27.C05.1.454.light.4.raw
tcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccactagggccactggtgtcccagacaggttcagtggcggtggatttgggacagagttttctctcaccatcagcgccctacagagtgaagatgttgcagtttatttctgccagcaatataattactggcctgcgtcgacgttcggccacggaccaaggtggaatacaaacgaactgtggctgcaccatctgtctt

SEQ ID NO: 544956 - DNA, 494 bp, Homo sapiens; identical to SEQ ID NO: 534992
  misc_feature: HIJSMM301DI1GX.9.1.A01.1.454.light.4.raw

SEQ ID NO: 544957 - DNA, 500 bp, Homo sapiens
  misc_feature: HIJSMM301BFJKU.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccggaacggtaggagttactaacgaaactagtggcgtgcaccactctgtcttc

SEQ ID NO: 544958 - DNA, 514 bp, Homo sapiens
  misc_feature: HIJSMM301EFKB4.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactactacctacggtccgaacggaacggacgacgtaggaggaattaaacgtaaaccgagttggcgtcgcaccaactactcgtcttctact

SEQ ID NO: 544959 - DNA, 476 bp, Homo sapiens
  misc_feature: HIJSMM301AYGZ6.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggcggagggaccaaggtggaggatcaaacgaactagt

SEQ ID NO: 544960 - DNA, 488 bp, Homo sapiens; identical to SEQ ID NO: 536554
  misc_feature: HIJSMM301ELV8Y.26.37.D04.1.454.light.4.raw

SEQ ID NO: 544961 - DNA, 499 bp, Homo sapiens
  misc_feature: HIJSMM301BT42D.40.73.G07.1.454.light.4.raw
tctagcgactcacgaccggtgctcgatttagctctacgctcagggggaagagctgctcagttaggacccagagggaaccatggaaaccccagcgcaacttctcttcctcctgctactctggctcccagaaaccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgctagtttattactgtcagcagcgtaccaactggccgctcactttcggcggaggcaccgaaggtggagatcagacgaactgtggctgcaccatctgtcttcatcttccccg

SEQ ID NO: 544962 - DNA, 491 bp, Homo sapiens
  misc_feature: HIJSMM301COFUL.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttatactgcatgcaagctctacaaactccctcaacgttcggcggagggaccaaggtggagatcaaacgaactgtggctgcaccatctgtcttca

SEQ ID NO: 544963 - DNA, 479 bp, Homo sapiens
  misc_feature: HIJSMM301D7BQZ.52.5.A05.1.454.light.4.raw
  modified_base (471)..(471): a, c, t, g, unknown or other
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtctacgtcagccaagctncccctcgg

SEQ ID NO: 544964 - DNA, 481 bp, Homo sapiens
  misc_feature: HIJSMM301D4TQ7.48.35.D02.1.454.light.4.raw
agtatacatacacgaccggtgctcgatttagcacacgatagttgggtttggggagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagatttgcagtgtattactgtcagcagtatggtagctcacctcaactcactttcggcggagggaccaaggtggaggatcaaacgaactgtgg

SEQ ID NO: 544965 - DNA, 496 bp, Homo sapiens; identical to SEQ ID NO: 537925
  misc_feature: HIJSMM301CPBD5.22.14.B03.1.454.light.4.raw

SEQ ID NO: 544966 - DNA, 494 bp, Homo sapiens; identical to SEQ ID NO: 536810
  misc_feature: HIJSMM301AP4XK.10.79.H02.1.454.light.4.raw

SEQ ID NO: 544967 - DNA, 506 bp, Homo sapiens
  misc_feature: HIJSMM301EDM72.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctgagcctgaagatgttgcagtttattactgtcaacatcgtaccgagtggcctccggggccactttcggccctgggaccaaggtggagatcaaacgaactgtggctgcaccatctgtcttcta

SEQ ID NO: 544968 - DNA, 486 bp, Homo sapiens; identical to SEQ ID NO: 536261
  misc_feature: HIJSMM301DSZM0.26.55.E11.1.454.light.4.raw

SEQ ID NO: 544969 - DNA, 490 bp, Homo sapiens
  misc_feature: HIJSMM301DZAJN.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccaaacctaggataatcagaacgaactgtgg

SEQ ID NO: 544970 - DNA, 491 bp, Homo sapiens; identical to SEQ ID NO: 535294
  misc_feature: HIJSMM301DAGIJ.16.68.G02.1.454.light.4.raw

SEQ ID NO: 544971 - DNA, 506 bp, Homo sapiens; identical to SEQ ID NO: 534969
  misc_feature: HIJSMM301DWGMD.18.37.D04.1.454.light.4.raw

SEQ ID NO: 544972 - DNA, 489 bp, Homo sapiens
  misc_feature: HIJSMM301DY2LQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaactttactactgtcaacagagttacagtacccccctcactttcggcggaggaccaaggcggagatcagacgaactgtggctgcaccatctgtcttcta

SEQ ID NO: 544973 - DNA, 523 bp, Homo sapiens
  misc_feature: HIJSMM301AV76X.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacctgtcactctgttcccgccctcctccgtcg

SEQ ID NO: 544974 - DNA, 478 bp, Homo sapiens
  misc_feature: HIJSMM301CRNE0.5.28.C06.1.454.light.4.raw
atcagacacgcacgaccggtgctcgatttagagctcacgtattgggtttgggggtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcacca

SEQ ID NO: 544975 - DNA, 448 bp, Homo sapiens; identical to SEQ ID NO: 540364
  misc_feature: HIJSMM301C7983.18.9.A09.1.454.light.4.raw

SEQ ID NO: 544976 - DNA, 509 bp, Homo sapiens
  misc_feature: HIJSMM301ALXSR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtaggaaagtacaaacgaaactagtggctgcaccatctgtcttcatcttccccg

SEQ ID NO: 544977 - DNA, 498 bp, Homo sapiens; identical to SEQ ID NO: 544565
  misc_feature: HIJSMM301B2G7Q.11.21.B10.1.454.light.4.raw

SEQ ID NO: 544978 - DNA, 510 bp, Homo sapiens
  misc_feature: HIJSMM301DNAGF.49.73.G07.1.454.light.4.raw
agtcgagagacacgaccggtgctcgatttagctctacgctcagggcacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatgtgctgactcagacaccctcggtgtcggtggccccaggacagacggccttgattccctgtatgggagacgacattggaagtaagagtgtccactggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcacg

SEQ ID NO: 544979 - DNA, 498 bp, Homo sapiens
  misc_feature: HIJSMM301D8HOM.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatcaaacgaaactgtggctgcaccatctgtcttcatcttcccgccat

SEQ ID NO: 544980 - DNA, 493 bp, Homo sapiens
  misc_feature: HIJSMM301EFJJK.26.11.A11.1.454.light.4.raw
agactatactcacgaccggtgctcgatttagctacgactgcgagggaaagggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccagggacccaggtggagatcagacgaactgtggctgcaccatctgtcttcatcttcccg

SEQ ID NO: 544981 - DNA, 492 bp, Homo sapiens
  misc_feature: HIJSMM301BLXBK.41.28.C06.1.454.light.4.raw
tctatactatcacgaccggtgctcgatttagagctcacgtattgggtttggggagagctctggggagtctgcaccatggcttggaccccactcctcttcctcaccctcctcctccactgcacagggtctctctcccagcttgtgctgactcaatcgccctctgcctctgcctccctgggaacctcggtcaagctcacctgcactctgagcagtggagacagcagacacgccatcgcatggcatcagcagcagccaggaaggggccctcgattcctgatgaaacttacttttgatggcagccacaccaagggggacgggatccctgatcgcttctcaggctccagctctggggctgagcgctacctttcgatctccagcctccagtctgaggatgaggctgactattactgtcagtcctgagacagggggcgttttggtgttcggcggagggaccagactgaccgtcctgggtcagcccaaggctgccccccg

SEQ ID NO: 544982 - DNA, 490 bp, Homo sapiens; identical to SEQ ID NO: 535234
  misc_feature: HIJSMM301DQNHA.17.21.B10.1.454.light.4.raw

SEQ ID NO: 544983 - DNA, 507 bp, Homo sapiens; identical to SEQ ID NO: 544198
  misc_feature: HIJSMM301AMPTC.15.5.A05.1.454.light.4.raw

SEQ ID NO: 544984 - DNA, 488 bp, Homo sapiens; identical to SEQ ID NO: 535568
  misc_feature: HIJSMM301CJ2P1.21.4.A04.1.454.light.4.raw

SEQ ID NO: 544985 - DNA, 507 bp, Homo sapiens; identical to SEQ ID NO: 535641
  misc_feature: HIJSMM301DHUEC.10.88.H11.1.454.light.4.raw

SEQ ID NO: 544986 - DNA, 488 bp, Homo sapiens; identical to SEQ ID NO: 540982
  misc_feature: HIJSMM301AM6H0.8.4.A04.1.454.light.4.raw

SEQ ID NO: 544987 - DNA, 505 bp, Homo sapiens
  misc_feature: HIJSMM301A73X4.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattatctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccaccctccc

SEQ ID NO: 544988 - DNA, 497 bp, Homo sapiens; identical to SEQ ID NO: 542618
  misc_feature: HIJSMM301EX3SV.16.46.E02.1.454.light.4.raw

SEQ ID NO: 544989 - DNA, 508 bp, Homo sapiens; identical to SEQ ID NO: 536388
  misc_feature: HIJSMM301BP4V4.11.57.F02.1.454.light.4.raw

SEQ ID NO: 544990 - DNA, 485 bp, Homo sapiens; identical to SEQ ID NO: 536576
  misc_feature: HIJSMM301BUH1L.46.35.D02.1.454.light.4.raw

SEQ ID NO: 544991 - DNA, 486 bp, Homo sapiens; identical to SEQ ID NO: 535385
  misc_feature: HIJSMM301EGWFY.19.71.G05.1.454.light.4.raw

SEQ ID NO: 544992 - DNA, 488 bp, Homo sapiens; identical to SEQ ID NO: 535081
  misc_feature: HIJSMM301AZ7YY.26.23.C01.1.454.light.4.raw

SEQ ID NO: 544993 - DNA, 482 bp, Homo sapiens; identical to SEQ ID NO: 544665
  misc_feature: HIJSMM301A2LA7.8.14.B03.1.454.light.4.raw

SEQ ID NO: 544994 - DNA, 485 bp, Homo sapiens; identical to SEQ ID NO: 535880
  misc_feature: HIJSMM301AID00.7.75.G09.1.454.light.4.raw

SEQ ID NO: 544995 - DNA, 490 bp, Homo sapiens
  misc_feature: HIJSMM301CF4M0.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtgggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactcgtggggtcccagacagattcagcggcagtgggtcaggcgctgatttcacactgagaatcagcagggtggaggctgaagatggtcggggtttattactgcatgcagggtacagtgtggccttcgctcgcattcggcggagggaccaaggtggagatacaaacgaa

SEQ ID NO: 544996 - DNA, 493 bp, Homo sapiens; identical to SEQ ID NO: 535745
  misc_feature: HIJSMM301CE80F.47.78.H01.1.454.light.4.raw

SEQ ID NO: 544997 - DNA, 383 bp, Homo sapiens
  misc_feature: HIJSMM301BR4V6.13.37.D04.1.454.light.4.raw
tcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctgttcccgccctcctctagtacgtga

SEQ ID NO: 544998 - DNA, 474 bp, Homo sapiens
  misc_feature: HIJSMM301BBJBQ.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgttttggtccagggaccaaggtggagatcaaacgaaactgtggctgcaccat

SEQ ID NO: 544999 - DNA, 477 bp, Homo sapiens; identical to SEQ ID NO: 535122
  misc_feature: HIJSMM301CAU1F.26.72.G06.1.454.light.4.raw

SEQ ID NO: 545000 - DNA, 486 bp, Homo sapiens
  misc_feature: HIJSMM301A0L06.49.53.E09.1.454.light.4.raw
agtcgagagacacgaccggtgctcgatttagagagagtgtgttgggtttgggggtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtcctaggtcagcccaaggctcg

SEQ ID NO: 545001 - DNA, 494 bp, Homo sapiens; identical to SEQ ID NO: 534994
  misc_feature: HIJSMM301CX965.27.78.H01.1.454.light.4.raw

SEQ ID NO: 545002 - DNA, 509 bp, Homo sapiens
  misc_feature: HIJSMM301BSHUR.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagccc

SEQ ID NO: 545003 - DNA, 502 bp, Homo sapiens; identical to SEQ ID NO: 536253
  misc_feature: HIJSMM301AP5KP.21.22.B11.1.454.light.4.raw

SEQ ID NO: 545004 - DNA, 505 bp, Homo sapiens; identical to SEQ ID NO: 535503
  misc_feature: HIJSMM301D7RTL.8.28.C06.1.454.light.4.raw

SEQ ID NO: 545005 - DNA, 503 bp, Homo sapiens; identical to SEQ ID NO: 536834
  misc_feature: HIJSMM301AFBMO.2.35.D02.1.454.light.4.raw

SEQ ID NO: 545006 - DNA, 485 bp, Homo sapiens; identical to SEQ ID NO: 535985
  misc_feature: HIJSMM301CH63R.15.1.A01.1.454.light.4.raw

SEQ ID NO: 545007 - DNA, 497 bp, Homo sapiens; identical to SEQ ID NO: 535664
  misc_feature: HIJSMM301AF3FD.22.14.B03.1.454.light.4.raw

SEQ ID NO: 545008 - DNA, 510 bp, Homo sapiens
  misc_feature: HIJSMM301BK8D9.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaaactgtggctgcaccatctgtcttcatcttcccg

SEQ ID NO: 545009 - DNA, 504 bp, Homo sapiens
  misc_feature: HIJSMM301B6RYZ.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtgggaccaaagtggagatcaaacgaactgtggctgcaccta

SEQ ID NO: 545010 - DNA, 505 bp, Homo sapiens
  misc_feature: HIJSMM301D9YRP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaacggtggaaatcaaacgaactgtggctgcaccatctcgtcttcactcttccccg

SEQ ID NO: 545011 - DNA, 496 bp, Homo sapiens
  misc_feature: HIJSMM301DP0YC.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccgccctcct

SEQ ID NO: 545012 - DNA, 487 bp, Homo sapiens
  misc_feature: HIJSMM301BGI20.52.83.H06.1.454.light.4.raw
cgcagtacgacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggcctctgggatccctgaccgattctctggctccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 545013 - DNA, 496 bp, Homo sapiens
  misc_feature: HIJSMM301BTNUU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctctacttcgtcggagggaccgaacggacggagatcagacgaactagtggcgtgcaccactctcgtcttcta

SEQ ID NO: 545014 - DNA, 497 bp, Homo sapiens; identical to SEQ ID NO: 536371
  misc_feature: HIJSMM301EDSK1.16.78.H01.1.454.light.4.raw

SEQ ID NO: 545015 - DNA, 484 bp, Homo sapiens
  misc_feature: HIJSMM301CWP0O.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgttcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagccctatgacaacaccctgcgttggttttggctgttcggcggcgggacaag

SEQ ID NO: 545016 - DNA, 481 bp, Homo sapiens; identical to SEQ ID NO: 535677
  misc_feature: HIJSMM301DC1V2.5.39.D06.1.454.light.4.raw

SEQ ID NO: 545017 - DNA, 444 bp, Homo sapiens; identical to SEQ ID NO: 537637
  misc_feature: HIJSMM301CAGKN.8.11.A11.1.454.light.4.raw

SEQ ID NO: 545018 - DNA, 383 bp, Homo sapiens
  misc_feature: HIJSMM301CX5EB.41.34.D01.1.454.light.4.raw
tctatactatcacgaccggtgctcgatttagatcgtctgtgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 545019 - DNA, 489 bp, Homo sapiens
  misc_feature: HIJSMM301CYZZ6.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccatctgtctt

SEQ ID NO: 545020 - DNA, 502 bp, Homo sapiens
  misc_feature: HIJSMM301D6BX5.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgaactgtggctgcaccatctgtctt

SEQ ID NO: 545021 - DNA, 496 bp, Homo sapiens
  misc_feature: HIJSMM301BIW7D.5.12.B01.1.454.light.4.raw
atcagacacgcacgaccggtgctcgatttagtagtgtagattccgcgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccg

SEQ ID NO: 545022 - DNA, 495 bp, Homo sapiens
  misc_feature: HIJSMM301D2A7B.5.24.C02.1.454.light.4.raw
atcagacacgcacgaccggtgctcgatttagtacagatcgttagggaaaggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctctggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagccc

SEQ ID NO: 545023 - DNA, 510 bp, Homo sapiens
  misc_feature: HIJSMM301BOBM4.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggtcggagggaccgaagctgaccgtcctgggtcagcccaaggctgccccctccggtcactctgtt

SEQ ID NO: 545024 - DNA, 485 bp, Homo sapiens; identical to SEQ ID NO: 535985
  misc_feature: HIJSMM301BQ2RJ.15.1.A01.1.454.light.4.raw

SEQ ID NO: 545025 - DNA, 493 bp, Homo sapiens; identical to SEQ ID NO: 544835
  misc_feature: HIJSMM301EOSWP.43.29.C07.1.454.light.4.raw

SEQ ID NO: 545026 - DNA, 482 bp, Homo sapiens; identical to SEQ ID NO: 539800
  misc_feature: HIJSMM301DH2MK.21.25.C03.1.454.light.4.raw

SEQ ID NO: 545027 - DNA, 480 bp, Homo sapiens
  misc_feature: HIJSMM301DHPKL.10.3.A03.1.454.light.4.raw
catagtagtgcacgaccggtgctcgatttagagagcgtcacagcatggacatgagggtccccgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaagccccgaaactcctgatccatactgcctccactttggcaagtggggtcccatcaaggttcagcggcagtggagctgggacagagttcactctcagtatcagcagcctgcagcctgatgattttgcaacctattattgtcaacaatatgacacttatccattctctttcggcactgggaccaaagtggattccaaacgaactgtggctgcaccatctgtcttcatcttcccgccatctgacacta

SEQ ID NO: 545028 - DNA, 505 bp, Homo sapiens; identical to SEQ ID NO: 535503
  misc_feature: HIJSMM301B9O4N.8.28.C06.1.454.light.4.raw

SEQ ID NO: 545029 - DNA, 483 bp, Homo sapiens; identical to SEQ ID NO: 536202
  misc_feature: HIJSMM301A79JB.43.24.C02.1.454.light.4.raw

SEQ ID NO: 545030 - DNA, 491 bp, Homo sapiens
  misc_feature: HIJSMM301B47HK.49.46.E02.1.454.light.4.raw
agtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaacgaactgtggctgcaccatctgtcttcat

SEQ ID NO: 545031 - DNA, 486 bp, Homo sapiens
  misc_feature: HIJSMM301BZWFK.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccagggtggaaatacaaacgaactagtggctgcaccatctgtctt

SEQ ID NO: 545032 - DNA, 493 bp, Homo sapiens
  misc_feature: HIJSMM301C8C00.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggtctgatcgggcctccggggtccctgacaggttcagtggcagtggatcaggcacagtattttacgctagaaaatcagtagggtggaggctgaggatggttggggtttattactgcatgcaagttctacaaaccttcctactacttttggccgaggggaccaagcgtggagatacaaacgaa

SEQ ID NO: 545033 - DNA, 494 bp, Homo sapiens; identical to SEQ ID NO: 534992
  misc_feature: HIJSMM301BGB85.9.1.A01.1.454.light.4.raw

SEQ ID NO: 545034 - DNA, 486 bp, Homo sapiens
  misc_feature: HIJSMM301AI2HK.26.37.D04.1.454.light.4.raw
agactatactcacgaccggtgctcgatttagtagcatactgttgggtttggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcgagggaccaaggttgagatcaaacgaactgtggctgcacca

SEQ ID NO: 545035 - DNA, 494 bp, Homo sapiens; identical to SEQ ID NO: 534992
  misc_feature: HIJSMM301DB5JG.9.1.A01.1.454.light.4.raw

SEQ ID NO: 545036 - DNA, 502 bp, Homo sapiens
  misc_feature: HIJSMM301AP083.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgctacgtaga

SEQ ID NO: 545037 - DNA, 449 bp, Homo sapiens
  misc_feature: HIJSMM301A1S80.40.14.B03.1.454.light.4.raw
tctagcgactcacgaccggtgctcgatttagtgtgagtagttccgcggggcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagggggtcatgatctcttgttttggaagtagctccaacatcggaagtaataatgtgaactggtctggcacctcagcctccctggccatcattgatctccagtctgaggatgaggctgactattactgttcagcatgggatgccagcctgaatgtctgggtgttcggcggagggaccaagttgaccgtcctaggtcagcccaaggctgccccctcggtcactctgttcccaccctcctcagtcgctaga

SEQ ID NO: 545038 - DNA, 491 bp, Homo sapiens
  misc_feature: HIJSMM301BSNF3.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaactggtgtcccatcaaggttcagcggcagtggatctgggacagaattcactctcgccatcagcagcctgcagcctgatgattctgcaacttattactgccaacagtattatagttatcgggggacgttcggccaagggaccaaggtggaaatcaaacgaactgtggctgcaccatctgt

SEQ ID NO: 545039 - DNA, 509 bp, Homo sapiens
  misc_feature: HIJSMM301CZNO3.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggaccaggctgaccgtcctaagtcagccaaggctgcccctcgg

SEQ ID NO: 545040 - DNA, 498 bp, Homo sapiens
  misc_feature: HIJSMM301A14Q9.19.78.H01.1.454.light.4.raw
tactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 545041 - DNA, 499 bp, Homo sapiens; identical to SEQ ID NO: 539754
  misc_feature: HIJSMM301BXRBN.11.21.B10.1.454.light.4.raw

SEQ ID NO: 545042 - DNA, 505 bp, Homo sapiens
  misc_feature: HIJSMM301DYRTR.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcta

SEQ ID NO: 545043 - DNA, 467 bp, Homo sapiens; identical to SEQ ID NO: 535997
  misc_feature: HIJSMM301EKD6B.5.36.D03.1.454.light.4.raw

SEQ ID NO: 545044 - DNA, 506 bp, Homo sapiens; identical to SEQ ID NO: 537290
  misc_feature: HIJSMM301AG9MC.13.11.A11.1.454.light.4.raw

SEQ ID NO: 545045 - DNA, 501 bp, Homo sapiens
  misc_feature: HIJSMM301AVYLG.52.35.D02.1.454.light.4.raw
cgcagtacgacacgaccggtgctcgatttagcacacgatagttgggtttgggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 545046 - DNA, 497 bp, Homo sapiens; identical to SEQ ID NO: 535740
  misc_feature: HIJSMM301AWA5J.3.71.G05.1.454.light.4.raw

SEQ ID NO: 545047 - DNA, 510 bp, Homo sapiens
  misc_feature: HIJSMM301EICQU.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgccact

SEQ ID NO: 545048 - DNA, 485 bp, Homo sapiens; identical to SEQ ID NO: 536040
  misc_feature: HIJSMM301BBH0N.15.1.A01.1.454.light.4.raw

SEQ ID NO: 545049 - DNA, 486 bp, Homo sapiens; identical to SEQ ID NO: 538751
  misc_feature: HIJSMM301CJV9B.3.10.A10.1.454.light.4.raw

SEQ ID NO: 545050 - DNA, 488 bp, Homo sapiens
  misc_feature: HIJSMM301ADC3E.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggccctcggacgttcggccaagggaccaaggtggaaatcaaacgaactgtggctgcaccatctgtcttc

SEQ ID NO: 545051 - DNA, 489 bp, Homo sapiens; identical to SEQ ID NO: 544819
  misc_feature: HIJSMM301BM27G.11.28.C06.1.454.light.4.raw

SEQ ID NO: 545052 - DNA, 484 bp, Homo sapiens; identical to SEQ ID NO: 537878
  misc_feature: HIJSMM301CA9XB.17.34.D01.1.454.light.4.raw

SEQ ID NO: 545053 - DNA, 377 bp, Homo sapiens; identical to SEQ ID NO: 536071
  misc_feature: HIJSMM301BMBZW.40.9.A09.1.454.light.4.raw

SEQ ID NO: 545054 - DNA, 500 bp, Homo sapiens
  misc_feature: HIJSMM301AEILP.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagtattttgtttttattattgtcagcagtatgataactggcctctgtggacgttcggaccaagggaccaaggtggatgtcaaacgaactgtggctgcaccatctgtcttcatt

SEQ ID NO: 545055 - DNA, 483 bp, Homo sapiens; identical to SEQ ID NO: 542200
  misc_feature: HIJSMM301DOHL1.7.75.G09.1.454.light.4.raw

SEQ ID NO: 545056 - DNA, 491 bp, Homo sapiens
  misc_feature: HIJSMM301BWY2M.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtccctcgggaccgacgagtggatgtcaacgaactagt

SEQ ID NO: 545057 - DNA, 483 bp, Homo sapiens
  misc_feature: HIJSMM301EJ4G9.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcct

SEQ ID NO: 545058 - DNA, 484 bp, Homo sapiens
  misc_feature: HIJSMM301EC7IV.10.2.A02.1.454.light.4.raw
catagtagtgcacgaccggtgctcgatttagactcatctacagggggaggaactgctcacttaggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagattttgcagtttattactgtcagcagtataatagctggcccgcgacgttcggccaagggaccgaggtggaattcaaatgaactgtggctgcaccatctgtt

SEQ ID NO: 545059 - DNA, 485 bp, Homo sapiens; identical to SEQ ID NO: 536040
  misc_feature: HIJSMM301BRL8I.15.1.A01.1.454.light.4.raw

SEQ ID NO: 545060 - DNA, 477 bp, Homo sapiens; identical to SEQ ID NO: 535506
  misc_feature: HIJSMM301EZ23F.7.67.G01.1.454.light.4.raw

SEQ ID NO: 545061 - DNA, 505 bp, Homo sapiens; identical to SEQ ID NO: 535503
  misc_feature: HIJSMM301EHCN4.8.28.C06.1.454.light.4.raw

SEQ ID NO: 545062 - DNA, 507 bp, Homo sapiens; identical to SEQ ID NO: 538063
  misc_feature: HIJSMM301AWZHU.47.85.H08.1.454.light.4.raw

SEQ ID NO: 545063 - DNA, 515 bp, Homo sapiens; identical to SEQ ID NO: 541016
  misc_feature: HIJSMM301C9Q1L.43.23.C01.1.454.light.4.raw

SEQ ID NO: 545064 - DNA, 504 bp, Homo sapiens
  misc_feature: HIJSMM301BQ6CF.41.18.B07.1.454.light.4.raw
tctatactatcacgaccggtgctcgatttagtcgctgcgtaagggggtgtggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccgttatcgggtgttcggcgggggaccgaacgctgaccgtcctaggtcgagcccaaggcgtgccccctccggtcgactcttcg

SEQ ID NO: 545065 - DNA, 513 bp, Homo sapiens
  misc_feature: HIJSMM301DFRFP.5.58.F03.1.454.light.4.raw
  modified_base (447)..(447): a, c, t, g, unknown or other
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttangttcgggactgggaccaaggtcaccgtcctaggtcagcccaaggccaaccccactgtcactcttcg

SEQ ID NO: 545066 - DNA, 461 bp, Homo sapiens; identical to SEQ ID NO: 538478
  misc_feature: HIJSMM301BXVWT.51.23.C01.1.454.light.4.raw

SEQ ID NO: 545067 - DNA, 444 bp, Homo sapiens; identical to SEQ ID NO: 535411
  misc_feature: HIJSMM301DFWKA.8.73.G07.1.454.light.4.raw

SEQ ID NO: 545068 - DNA, 477 bp, Homo sapiens
  misc_feature: HIJSMM301DKM1I.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaacgaactgtgg

SEQ ID NO: 545069 - DNA, 485 bp, Homo sapiens
  misc_feature: HIJSMM301C26ZV.5.39.D06.1.454.light.4.raw
atcagacacgcacgaccggtgctcgatttagtgacatctcgcagttctttgggcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtgggtccaccaacgttcagcggcagtggatctgggacagagttcactctcaccatcagcagcctgcagcctgatgatcttggaacttattactgccaacaatataatagttattggacgttcggccaac

SEQ ID NO: 545070 - DNA, 480 bp, Homo sapiens
  misc_feature: HIJSMM301DN016.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctgggaccaatgtggatatcaacgaactgtggctgcaccatctgtt

SEQ ID NO: 545071 - DNA, 447 bp, Homo sapiens; identical to SEQ ID NO: 535201
  misc_feature: HIJSMM301BNCNL.18.9.A09.1.454.light.4.raw

SEQ ID NO: 545072 - DNA, 496 bp, Homo sapiens
  misc_feature: HIJSMM301BRIBI.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctggggacagacttcactctcaccatcagcagactagagcctgaagattttgcagtttattactgtcagcagcgtagcaactggcctcggacgttcggccaacgggaccgaacgtaggacatcaagcgaactagtggctgcaccatctgtt

SEQ ID NO: 545073 - DNA, 503 bp, Homo sapiens
  misc_feature: HIJSMM301CQI7U.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtcggggccccatcaaggttcagtggcagtggctctgggacagtatttcactctcaccatcagcagtctccaacctgaagattttgcaacttactactgtcaacagagtttcagtacgtccccggacgttcggtcgaacggaccgaacggtaggacgatacaaacgaactagtggctgcaccaactctgtctt

SEQ ID NO: 545074 - DNA, 512 bp, Homo sapiens
  misc_feature: HIJSMM301EYISF.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgccctctcccccctactaatttcggttcgacgggacggaacttaggtaacaatcaatacgaacctagttggcgtcgcacccaatcttcgtcttt

SEQ ID NO: 545075 - DNA, 490 bp, Homo sapiens; identical to SEQ ID NO: 537951
  misc_feature: HIJSMM301COPAI.19.57.F02.1.454.light.4.raw

SEQ ID NO: 545076 - DNA, 486 bp, Homo sapiens; identical to SEQ ID NO: 535917
  misc_feature: HIJSMM301BKELU.3.10.A10.1.454.light.4.raw

SEQ ID NO: 545077 - DNA, 447 bp, Homo sapiens; identical to SEQ ID NO: 541817
  misc_feature: HIJSMM301AZI3C.18.9.A09.1.454.light.4.raw

SEQ ID NO: 545078 - DNA, 490 bp, Homo sapiens; identical to SEQ ID NO: 544430
  misc_feature: HIJSMM301EDG3Z.10.20.B09.1.454.light.4.raw

SEQ ID NO: 545079 - DNA, 510 bp, Homo sapiens; identical to SEQ ID NO: 535376
  misc_feature: HIJSMM301AHB4D.17.33.C11.1.454.light.4.raw

SEQ ID NO: 545080 - DNA, 494 bp, Homo sapiens
  misc_feature: HIJSMM301A0HUT.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccgaaactgaccgtcctaggtcagcccaaggctgccccctcggtcacctctgtt

SEQ ID NO: 545081 - DNA, 441 bp, Homo sapiens; identical to SEQ ID NO: 535074
  misc_feature: HIJSMM301D3FSF.11.3.A03.1.454.light.4.raw

SEQ ID NO: 545082 - DNA, 481 bp, Homo sapiens
  misc_feature: HIJSMM301BFPVR.43.81.H04.1.454.light.4.raw
tgtgagtagtcacgaccggtgctcgatttagtagtgtagattcgcggggggagtcagacccacgtcaggacacagcatggacatgagggtccccgcctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcacc

SEQ ID NO: 545083 - DNA, 447 bp, Homo sapiens; identical to SEQ ID NO: 541817
  misc_feature: HIJSMM301DSTAS.18.9.A09.1.454.light.4.raw

SEQ ID NO: 545084 - DNA, 441 bp, Homo sapiens; identical to SEQ ID NO: 535074
  misc_feature: HIJSMM301CBPG5.11.3.A03.1.454.light.4.raw

SEQ ID NO: 545085 - DNA, 508 bp, Homo sapiens
  misc_feature: HIJSMM301DB7KV.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatccttcccgcc

SEQ ID NO: 545086 - DNA, 487 bp, Homo sapiens; identical to SEQ ID NO: 535598
  misc_feature: HIJSMM301DK7EA.3.12.B01.1.454.light.4.raw

SEQ ID NO: 545087 - DNA, 486 bp, Homo sapiens
  misc_feature: HIJSMM301A25NV.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcgacggggtccctgaccgattctctggctccaagtctggcacctcagcctccctggtcatcgctgggctccaggctgacgatgaggctgattattattgccagtcctatgacaacaccctcgcgttggttttggtctgttcggcggcgggacg

SEQ ID NO: 545088 - DNA, 487 bp, Homo sapiens
  misc_feature: HIJSMM301A9XRY.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttggcggagggaccaaggttgagatcaaacgaactgtggctgcacca

SEQ ID NO: 545089 - DNA, 494 bp, Homo sapiens; identical to SEQ ID NO: 534994
  misc_feature: HIJSMM301ALQPC.27.78.H01.1.454.light.4.raw

SEQ ID NO: 545090 - DNA, 477 bp, Homo sapiens
  misc_feature: HIJSMM301DI93H.41.68.G02.1.454.light.4.raw
tctatactatcacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggaggaccaaggtggagatcaaacgaactgtgg

SEQ ID NO: 545091 - DNA, 473 bp, Homo sapiens; identical to SEQ ID NO: 535262
  misc_feature: HIJSMM301DJSP5.8.67.G01.1.454.light.4.raw

SEQ ID NO: 545092 - DNA, 463 bp, Homo sapiens
  misc_feature: HIJSMM301C64QC.17.28.C06.1.454.light.4.raw
cgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcttcctagtctacg

SEQ ID NO: 545093 - DNA, 486 bp, Homo sapiens
  misc_feature: HIJSMM301EJGD7.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacaatgactggccgtacacttttggccaggggaccaagctggagatcaaacgaactgtggctgcaccatctgtctt

SEQ ID NO: 545094 - DNA, 485 bp, Homo sapiens; identical to SEQ ID NO: 536040
  misc_feature: HIJSMM301DYVAV.15.1.A01.1.454.light.4.raw

SEQ ID NO: 545095 - DNA, 498 bp, Homo sapiens; identical to SEQ ID NO: 535295
  misc_feature: HIJSMM301AXXMK.15.25.C03.1.454.light.4.raw

SEQ ID NO: 545096 - DNA, 506 bp, Homo sapiens; identical to SEQ ID NO: 535404
  misc_feature: HIJSMM301BBS1K.10.88.H11.1.454.light.4.raw

SEQ ID NO: 545097 - DNA, 509 bp, Homo sapiens; identical to SEQ ID NO: 542213
  misc_feature: HIJSMM301A0NYZ.17.41.D08.1.454.light.4.raw

SEQ ID NO: 545098 - DNA, 497 bp, Homo sapiens
  misc_feature: HIJSMM301B8D0S.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagcccaggttcagtggcagtgggtctggaagagacttcactctcaccatcaacagcctagagcctgacgattctgcagtttattactgtcagcagcgtaccaagtggcctccgacttttggccaggggccaagctggagatcagacgaactgtggctgcaccatctgtcttcatcttccccg

SEQ ID NO: 545099 - DNA, 470 bp, Homo sapiens; identical to SEQ ID NO: 535302
  misc_feature: HIJSMM301AG5S5.13.76.G10.1.454.light.4.raw

SEQ ID NO: 545100 - DNA, 505 bp, Homo sapiens; identical to SEQ ID NO: 536254
  misc_feature: HIJSMM301AVM04.7.71.G05.1.454.light.4.raw

SEQ ID NO: 545101 - DNA, 496 bp, Homo sapiens; identical to SEQ ID NO: 540287
  misc_feature: HIJSMM301DZPAQ.40.11.A11.1.454.light.4.raw

SEQ ID NO: 545102 - DNA, 492 bp, Homo sapiens; identical to SEQ ID NO: 534967
  misc_feature: HIJSMM301A89WG.47.64.F09.1.454.light.4.raw

SEQ ID NO: 545103 - DNA, 485 bp, Homo sapiens
  misc_feature: HIJSMM301BU9SK.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagagttcactctcacaatcagcagcctgcagcctgatgatcttggaacttattactgccaacaatataatagttattggacgttcggccaggggacgaaggtcgaaatgagacgaactgtggctgcaccatctgtt

SEQ ID NO: 545104 - DNA, 497 bp, Homo sapiens; identical to SEQ ID NO: 536371
  misc_feature: HIJSMM301AMCA5.16.78.H01.1.454.light.4.raw

SEQ ID NO: 545105 - DNA, 497 bp, Homo sapiens; identical to SEQ ID NO: 535740
  misc_feature: HIJSMM301BRQ9F.3.71.G05.1.454.light.4.raw

SEQ ID NO: 545106 - DNA, 500 bp, Homo sapiens
  misc_feature: HIJSMM301DNUFL.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtcttaggtcagcccaaggctgccccctcggtca

SEQ ID NO: 545107 - DNA, 498 bp, Homo sapiens
  misc_feature: HIJSMM301AMF4M.48.30.C08.1.454.light.4.raw
agtatacatacacgaccggtgctcgatttagtctgacgtcaaaggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaaggacacgactggagattaaacgaactgtggctgcaccatctgtcttcatcttcccg

SEQ ID NO: 545108 - DNA, 481 bp, Homo sapiens
  misc_feature: HIJSMM301EV8E1.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactaccctctcactttcggcgggggaccaaggtggagatcaaacgaactagtggctgcacca

SEQ ID NO: 545109 - DNA, 404 bp, Homo sapiens; identical to SEQ ID NO: 535530
  misc_feature: HIJSMM301AQJ3P.4.35.D02.1.454.light.4.raw

SEQ ID NO: 545110 - DNA, 508 bp, Homo sapiens
  misc_feature: HIJSMM301BD6CN.17.41.D08.1.454.light.4.raw
cgtagactagcacgaccggtgctcgatttagtcacgcgagaaagggaaaggggagagctgctcagttaggacccagagggaaccatggaaaccccagcgtagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgccat

SEQ ID NO: 545111 - DNA, 494 bp, Homo sapiens; identical to SEQ ID NO: 534992
  misc_feature: HIJSMM301CFPBH.9.1.A01.1.454.light.4.raw

SEQ ID NO: 545112 - DNA, 504 bp, Homo sapiens; identical to SEQ ID NO: 543615
  misc_feature: HIJSMM301AZSUX.11.67.G01.1.454.light.4.raw

SEQ ID NO: 545113 - DNA, 484 bp, Homo sapiens; identical to SEQ ID NO: 542211
  misc_feature: HIJSMM301D3YOP.13.36.D03.1.454.light.4.raw

SEQ ID NO: 545114 - DNA, 499 bp, Homo sapiens
  misc_feature: HIJSMM301CP8ES.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagccaaggctgccccctcggtcact

SEQ ID NO: 545115 - DNA, 510 bp, Homo sapiens
  misc_feature: HIJSMM301ATXN6.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccg

SEQ ID NO: 545116 - DNA, 485 bp, Homo sapiens; identical to SEQ ID NO: 536630
  misc_feature: HIJSMM301AOGHR.13.56.F01.1.454.light.4.raw

SEQ ID NO: 545117 - DNA, 507 bp, Homo sapiens; identical to SEQ ID NO: 535930
  misc_feature: HIJSMM301EUQ0K.15.34.D01.1.454.light.4.raw

SEQ ID NO: 545118 - DNA, 447 bp, Homo sapiens; identical to SEQ ID NO: 535020
  misc_feature: HIJSMM301BQ9DF.18.9.A09.1.454.light.4.raw

SEQ ID NO: 545119 - DNA, 477 bp, Homo sapiens
  misc_feature: HIJSMM301CVMYL.48.29.C07.1.454.light.4.raw
  modified_base (448)..(448): a, c, t, g, unknown or other
agtatacatacacgaccggtgctcgatttagagtgctacgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattatactgctgctcatatgcaggcagctacactttggngttcggcggagggaccaagctgactgtcc

SEQ ID NO: 545120 - DNA, 483 bp, Homo sapiens; identical to SEQ ID NO: 535317
  misc_feature: HIJSMM301BZWQP.4.1.A01.1.454.light.4.raw

SEQ ID NO: 545121 - DNA, 489 bp, Homo sapiens; identical to SEQ ID NO: 535139
  misc_feature: HIJSMM301CAJQA.14.55.E11.1.454.light.4.raw

SEQ ID NO: 545122 - DNA, 513 bp, Homo sapiens
  misc_feature: HIJSMM301ASGZH.48.81.H04.1.454.light.4.raw
agtatacatacacgaccggtgctcgatttagtagtgtagattcgcggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaagctgaccgtcctacgtcagcccaaggctgccccctcggt

SEQ ID NO: 545123 - DNA, 494 bp, Homo sapiens; identical to SEQ ID NO: 534992
  misc_feature: HIJSMM301CUCR4.9.1.A01.1.454.light.4.raw

SEQ ID NO: 545124 - DNA, 495 bp, Homo sapiens; identical to SEQ ID NO: 538651
  misc_feature: HIJSMM301CTMN9.10.79.H02.1.454.light.4.raw

SEQ ID NO: 545125 - DNA, 483 bp, Homo sapiens; identical to SEQ ID NO: 535480
  misc_feature: HIJSMM301EEBB5.46.26.C04.1.454.light.4.raw

SEQ ID NO: 545126 - DNA, 508 bp, Homo sapiens
  misc_feature: HIJSMM301DZ6ZQ.4.39.D06.1.454.light.4.raw
agcactgtagcacgaccggtgctcgatttagtgacatctcgcagttctttgggggggtctcaggaggcagcgctctcgggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcgggcggaggggaccaaactcgaccgtcctaggtcagcccaaggctcgccccctcggt

SEQ ID NO: 545127 - DNA, 485 bp, Homo sapiens; identical to SEQ ID NO: 536040
  misc_feature: HIJSMM301BREK9.15.1.A01.1.454.light.4.raw

SEQ ID NO: 545128 - DNA, 501 bp, Homo sapiens
  misc_feature: HIJSMM301DD79D.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgacgtcctaggtcagcccaaggctgccccctc

SEQ ID NO: 545129 - DNA, 520 bp, Homo sapiens
  misc_feature: HIJSMM301CG4X2.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagttatgttacgtccccgtggacgttcggccaagggaccaaggtggcaatcaaccgaactgtggctgcaccatctgtcttcatcttccccg

SEQ ID NO: 545130 - DNA, 511 bp, Homo sapiens
  misc_feature: HIJSMM301DK7I8.18.26.C04.1.454.light.4.raw
tacgagtatgcacgaccggtgctcgatttagtctagcgactttggggtttggggggtcgagacccacgtcgggacgacagcatggacatgagggtccccggcctcagctcctggggcgtcctgctgctctggttcccacggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctggggacagatttcactctcacccatcaccagcctgcagcctgaagattttgcaacttactattgtcaacaggctgacaggttcccgctgactttcggcggagggaccaaggtagagatcaaaggaactgtggctgcaccatctgtcttcatccttccgccca

SEQ ID NO: 545131 - DNA, 478 bp, Homo sapiens
  misc_feature: HIJSMM301DDZW0.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattactgcatgcaagctctacaaaccctattcactttcggccctgggaccagagtggataa

SEQ ID NO: 545132 - DNA, 463 bp, Homo sapiens; identical to SEQ ID NO: 535008
  misc_feature: HIJSMM301DXUN6.10.9.A09.1.454.light.4.raw

SEQ ID NO: 545133 - DNA, 499 bp, Homo sapiens
  misc_feature: HIJSMM301CLRNZ.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgccccctcggtcactctgttcccg

SEQ ID NO: 545134 - DNA, 484 bp, Homo sapiens; identical to SEQ ID NO: 539370
  misc_feature: HIJSMM301DEIYA.22.73.G07.1.454.light.4.raw

SEQ ID NO: 545135 - DNA, 494 bp, Homo sapiens; identical to SEQ ID NO: 540913
  misc_feature: HIJSMM301EQYK8.26.72.G06.1.454.light.4.raw

SEQ ID NO: 545136 - DNA, 457 bp, Homo sapiens
  misc_feature: HIJSMM301EGCX3.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggttttcggcggagggaccaagctgaccgtcctaagtcagcccaaggctcgccccctcggtcactctcgttcccaccctcctccacgagagta

SEQ ID NO: 545137 - DNA, 504 bp, Homo sapiens
  misc_feature: HIJSMM301BP3HO.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaaggaccaaggtggaaatacaaacgaactgtggctgcaccat

SEQ ID NO: 545138 - DNA, 458 bp, Homo sapiens
  misc_feature: HIJSMM301BIG4O.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttcccgccatctgacacgagagta

SEQ ID NO: 545139 - DNA, 486 bp, Homo sapiens; identical to SEQ ID NO: 544298
  misc_feature: HIJSMM301ERKDV.40.83.H06.1.454.light.4.raw

SEQ ID NO: 545140 - DNA, 501 bp, Homo sapiens
  misc_feature: HIJSMM301BV2TM.41.73.G07.1.454.light.4.raw
tctatactatcacgaccggtgctcgatttagctctacgctcagggcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaattaaacgaa

SEQ ID NO: 545141 - DNA, 515 bp, Homo sapiens
  misc_feature: HIJSMM301AOA4M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaacggtagggaaagtacaaacgaaacctagtggcgtgcaccatctgtcttctatctttccccg

SEQ ID NO: 545142 - DNA, 454 bp, Homo sapiens; identical to SEQ ID NO: 535005
  misc_feature: HIJSMM301DFGI3.19.86.H09.1.454.light.4.raw

SEQ ID NO: 545143 - DNA, 494 bp, Homo sapiens; identical to SEQ ID NO: 534992
  misc_feature: HIJSMM301D02QG.9.1.A01.1.454.light.4.raw

SEQ ID NO: 545144 - DNA, 493 bp, Homo sapiens; identical to SEQ ID NO: 535047
  misc_feature: HIJSMM301AYGIA.16.53.E09.1.454.light.4.raw

SEQ ID NO: 545145 - DNA, 485 bp, Homo sapiens
  misc_feature: HIJSMM301AVROD.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtggggctccggtccgaggatgaggctgattattattgtgcaacatgggatagtagcctgagtagtgtggttttcggcgggagggaccaaactgaccgtcctaggtcagccaaggctgccccctcggtcactctgttcccgcctcctctacgtgagct

SEQ ID NO: 545146 - DNA, 497 bp, Homo sapiens
  misc_feature: HIJSMM301CTFWS.43.25.C03.1.454.light.4.raw
tgtgagtagtcacgaccggtgctcgatttagtagtgtagatttgggtttggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgca

SEQ ID NO: 545147 - DNA, 489 bp, Homo sapiens; identical to SEQ ID NO: 536663
  misc_feature: HIJSMM301AP65K.16.72.G06.1.454.light.4.raw

SEQ ID NO: 545148 - DNA, 479 bp, Homo sapiens; identical to SEQ ID NO: 536050
  misc_feature: HIJSMM301A4VZ6.5.73.G07.1.454.light.4.raw

SEQ ID NO: 545149 - DNA, 493 bp, Homo sapiens; identical to SEQ ID NO: 536969
  misc_feature: HIJSMM301A9UM2.27.78.H01.1.454.light.4.raw

SEQ ID NO: 545150 - DNA, 489 bp, Homo sapiens
  misc_feature: HIJSMM301ANSL5.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccagggaccgaagctggagatcacaggaactgtggctgcaccat

SEQ ID NO: 545151 - DNA, 503 bp, Homo sapiens; identical to SEQ ID NO: 542867
  misc_feature: HIJSMM301A36U8.14.57.F02.1.454.light.4.raw

SEQ ID NO: 545152 - DNA, 500 bp, Homo sapiens; identical to SEQ ID NO: 535310
  misc_feature: HIJSMM301A7Z0K.47.66.F11.1.454.light.4.raw

SEQ ID NO: 545153 - DNA, 489 bp, Homo sapiens; identical to SEQ ID NO: 538498
  misc_feature: HIJSMM301C73RQ.19.71.G05.1.454.light.4.raw

SEQ ID NO: 545154 - DNA, 484 bp, Homo sapiens
  misc_feature: HIJSMM301DLVK1.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcttagcagcctgcagtctgaagatttgcggtttattactgtcagcagtatgataactggctgtacacttttggtccaggggaccaagctggagatcaggcgaactgtggctgca

SEQ ID NO: 545155 - DNA, 506 bp, Homo sapiens
  misc_feature: HIJSMM301DPRZ7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaactagtggctgcaccatctgtcttcatcttccccg

SEQ ID NO: 545156 - DNA, 490 bp, Homo sapiens; identical to SEQ ID NO: 535234
  misc_feature: HIJSMM301EUG4J.17.21.B10.1.454.light.4.raw

SEQ ID NO: 545157 - DNA, 489 bp, Homo sapiens; identical to SEQ ID NO: 544329
  misc_feature: HIJSMM301BWKBJ.11.28.C06.1.454.light.4.raw

SEQ ID NO: 545158 - DNA, 487 bp, Homo sapiens; identical to SEQ ID NO: 537220
  misc_feature: HIJSMM301AYV8P.16.53.E09.1.454.light.4.raw

SEQ ID NO: 545159 - DNA, 482 bp, Homo sapiens; identical to SEQ ID NO: 537007
  misc_feature: HIJSMM301AMZZ2.41.34.D01.1.454.light.4.raw

SEQ ID NO: 545160 - DNA, 494 bp, Homo sapiens
  misc_feature: HIJSMM301CMUFV.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcactctcg

SEQ ID NO: 545161 - DNA, 503 bp, Homo sapiens
  misc_feature: HIJSMM301DS5OY.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtcctggcaacacggcctccctgacaatctctgggctccaggctgaggacgaggcggattattactgttgctcatatgcgggtagtagcactttcgatgtcctattcggcggagggaccaagctgaccgtcctgggtcagccaaggctgcccctcggtcactctgttcccaccctcctctacgtcgtat

SEQ ID NO: 545162 - DNA, 495 bp, Homo sapiens
  misc_feature: HIJSMM301AY3BN.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccactct

SEQ ID NO: 545163 - DNA, 447 bp, Homo sapiens; identical to SEQ ID NO: 535201
  misc_feature: HIJSMM301DKNYO.18.9.A09.1.454.light.4.raw

SEQ ID NO: 545164 - DNA, 495 bp, Homo sapiens; identical to SEQ ID NO: 543631
  misc_feature: HIJSMM301DAMYL.11.59.F04.1.454.light.4.raw

SEQ ID NO: 545165 - DNA, 496 bp, Homo sapiens
  misc_feature: HIJSMM301C4RNL.5.3.A03.1.454.light.4.raw
atcagacacgcacgaccggtgctcgatttagagagcgtcacaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtcctaggtcagcccaacggctgccccccg

SEQ ID NO: 545166 - DNA, 477 bp, Homo sapiens
  misc_feature: HIJSMM301BDXQJ.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgca

SEQ ID NO: 545167 - DNA, 491 bp, Homo sapiens
  misc_feature: HIJSMM301D59HY.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtcact

SEQ ID NO: 545168 - DNA, 486 bp, Homo sapiens
  misc_feature: HIJSMM301CBB2C.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctaggagat

SEQ ID NO: 545169 - DNA, 497 bp, Homo sapiens
  misc_feature: HIJSMM301DB4Q0.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgcccctcggt

SEQ ID NO: 545170 - DNA, 462 bp, Homo sapiens; identical to SEQ ID NO: 542244
  misc_feature: HIJSMM301EOVKW.49.73.G07.1.454.light.4.raw

SEQ ID NO: 545171 - DNA, 511 bp, Homo sapiens
  misc_feature: HIJSMM301C9BQS.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcgttcggccaagggaccgaaggtaggaaagtacaaaacgaactagtggctgcacccatctgtcttcatcttccccg

SEQ ID NO: 545172 - DNA, 505 bp, Homo sapiens
  misc_feature: HIJSMM301ALXZB.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggcggacggaccgaagggcggagactacgagaacgaacgtggtcggctcgaccacctactctgttctta

SEQ ID NO: 545173 - DNA, 494 bp, Homo sapiens; identical to SEQ ID NO: 534992
  misc_feature: HIJSMM301AG7HV.9.1.A01.1.454.light.4.raw

SEQ ID NO: 545174 - DNA, 491 bp, Homo sapiens
  misc_feature: HIJSMM301CRI5S.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccaggggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggaccaagctggagatcaaacgaactgt

SEQ ID NO: 545175 - DNA, 487 bp, Homo sapiens
  misc_feature: HIJSMM301AKBDD.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaggagtcaccctctcctgcagggccagtcagagtgttagtcgcggcttagcctggtaccagcagacacctgggcagactcccaggctcctcatttatgttgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtggctgcacc

SEQ ID NO: 545176 - DNA, 513 bp, Homo sapiens; identical to SEQ ID NO: 535244
  misc_feature: HIJSMM301BZNL7.17.33.C11.1.454.light.4.raw

SEQ ID NO: 545177 - DNA, 513 bp, Homo sapiens
  misc_feature: HIJSMM301BAAPB.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccgccctcctcga

SEQ ID NO: 545178 - DNA, 513 bp, Homo sapiens
  misc_feature: HIJSMM301B12BN.7.34.D01.1.454.light.4.raw
cgtgtctctacacgaccggtgctcgatttagatcgtctgtgttggggtttggggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagtccaaggctcgccccctcggtcact

SEQ ID NO: 545179 - DNA, 478 bp, Homo sapiens
  misc_feature: HIJSMM301BN4W7.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaggtcagcccaa

SEQ ID NO: 545180 - DNA, 494 bp, Homo sapiens
  misc_feature: HIJSMM301BM3LE.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaaatcaaacgaactgtggctgcaccatctgtcttcta

SEQ ID NO: 545181 - DNA, 507 bp, Homo sapiens
  misc_feature: HIJSMM301C9LGQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtggaaagtacaaacgaactagtggctgcaccatctgtcttcatcttccccg

SEQ ID NO: 545182 - DNA, 496 bp, Homo sapiens
  misc_feature: HIJSMM301C5WOA.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactatactgtcaatcagcagacagcagtggtacttttcgggttttcggtcggagggaccaagctgaccgtcctaggtcagcccaaggctgcccctcggt

SEQ ID NO: 545183 - DNA, 495 bp, Homo sapiens
  misc_feature: HIJSMM301BDUTQ.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgttcccg

SEQ ID NO: 545184 - DNA, 484 bp, Homo sapiens; identical to SEQ ID NO: 535240
  misc_feature: HIJSMM301BLDM2.47.60.F05.1.454.light.4.raw

SEQ ID NO: 545185 - DNA, 518 bp, Homo sapiens
  misc_feature: HIJSMM301A8JWW.41.55.E11.1.454.light.4.raw
tctatactatcacgaccggtgctcgatttagcactcgcacgttgggtttggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccctcctc

SEQ ID NO: 545186 - DNA, 494 bp, Homo sapiens
  misc_feature: HIJSMM301DV06S.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactgtggctgcaccatctgtcttcat

SEQ ID NO: 545187 - DNA, 504 bp, Homo sapiens
  misc_feature: HIJSMM301CF6RY.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttcccgcctcctccgtgt

SEQ ID NO: 545188 - DNA, 494 bp, Homo sapiens
  misc_feature: HIJSMM301CK9FH.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccagggaccaagctggagatcaaacgaactgtggctgcaccatctgtcttcta

SEQ ID NO: 545189 - DNA, 493 bp, Homo sapiens; identical to SEQ ID NO: 536769
  misc_feature: HIJSMM301DKXEE.19.83.H06.1.454.light.4.raw

SEQ ID NO: 545190 - DNA, 487 bp, Homo sapiens
  misc_feature: HIJSMM301A49KW.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaggtggagatcaaacgaactagtggctgcaccat

SEQ ID NO: 545191 - DNA, 497 bp, Homo sapiens
  misc_feature: HIJSMM301C62D8.48.58.F03.1.454.light.4.raw
agtatacatacacgaccggtgctcgatttagtctgatcgagaagggaaagggggaggaactgctcagttaggacccagacggaaccatggaagccccagcgcagcttctcttcctcctgctactctggctcccagatgtcactggagaaaaataatgacgcagtctccagccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtgg

SEQ ID NO: 545192 - DNA, 505 bp, Homo sapiens; identical to SEQ ID NO: 537876
  misc_feature: HIJSMM301CQ5QG.5.68.G02.1.454.light.4.raw

SEQ ID NO: 545193 - DNA, 476 bp, Homo sapiens; identical to SEQ ID NO: 537812
  misc_feature: HIJSMM301D68UW.3.82.H05.1.454.light.4.raw

SEQ ID NO: 545194 - DNA, 492 bp, Homo sapiens
  misc_feature: HIJSMM301B3R3U.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttattctgtcaccagtatggtaggtcaccgtacacttttggtccagggaccaagctggagatcaagcgaactgtggctgcaccatctgtcttcta

SEQ ID NO: 545195 - DNA, 485 bp, Homo sapiens; identical to SEQ ID NO: 541984
  misc_feature: HIJSMM301B6IZY.40.69.G03.1.454.light.4.raw

SEQ ID NO: 545196 - DNA, 493 bp, Homo sapiens
  misc_feature: HIJSMM301EXPG8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagacccctgacctcctgatctatgctgcatccagtttgcacagtggggtcccgtcaaggttcagtggcagtggatctgggacagatttcactctcaccgtcagcagtctgcaacctgaagattttgcaacttactactgttcaacagagttacagttacccccctcacctttcggcggagggaccaaggcggagatcagacgaactgtggctgcaccatctgtcttcta

SEQ ID NO: 545197 - DNA, 484 bp, Homo sapiens; identical to SEQ ID NO: 536162
  misc_feature: HIJSMM301ELIQX.13.59.F04.1.454.light.4.raw

SEQ ID NO: 545198 - DNA, 404 bp, Homo sapiens; identical to SEQ ID NO: 535530
  misc_feature: HIJSMM301CPONI.4.35.D02.1.454.light.4.raw

SEQ ID NO: 545199 - DNA, 441 bp, Homo sapiens
  misc_feature: HIJSMM301C1GUZ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 545200 - DNA, 515 bp, Homo sapiens
  misc_feature: HIJSMM301C5256.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtccactctcgttcccaccctcctctacgtcgtat

SEQ ID NO: 545201 - DNA, 494 bp, Homo sapiens; identical to SEQ ID NO: 535828
  misc_feature: HIJSMM301D20LI.3.36.D03.1.454.light.4.raw

SEQ ID NO: 545202 - DNA, 499 bp, Homo sapiens
  misc_feature: HIJSMM301A6DGQ.12.26.C04.1.454.light.4.raw
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcggcggagggaccaaggtggagatcaaacgaactgtggctgcacca

SEQ ID NO: 545203 - DNA, 491 bp, Homo sapiens; identical to SEQ ID NO: 535194
  misc_feature: HIJSMM301EPWVB.26.78.H01.1.454.light.4.raw

SEQ ID NO: 545204 - DNA, 496 bp, Homo sapiens
  misc_feature: HIJSMM301ALMEI.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccgacgggaccgacggtcggagtgttcgaagcgaactcgtggcgtgcaccactcttcg

SEQ ID NO: 545205 - DNA, 521 bp, Homo sapiens; identical to SEQ ID NO: 539470
  misc_feature: HIJSMM301BY72I.27.23.C01.1.454.light.4.raw

SEQ ID NO: 545206 - DNA, 499 bp, Homo sapiens
  misc_feature: HIJSMM301CEXCE.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggtacttttggccgaggggaccgaagcgtggagatcaaacgaactgtggctgcaccatctgtcttcta

SEQ ID NO: 545207 - DNA, 444 bp, Homo sapiens; identical to SEQ ID NO: 534993
  misc_feature: HIJSMM301ECLHV.5.9.A09.1.454.light.4.raw

SEQ ID NO: 545208 - DNA, 476 bp, Homo sapiens
  misc_feature: HIJSMM301C4KHG.3.1.A01.1.454.light.4.raw
agacgcactccacgaccggtgctcgatttagacgtctcatcaggggaggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcttggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaactagtggctgcacc

SEQ ID NO: 545209 - DNA, 454 bp, Homo sapiens; identical to SEQ ID NO: 534964
  misc_feature: HIJSMM301DEH5S.19.86.H09.1.454.light.4.raw

SEQ ID NO: 545210 - DNA, 490 bp, Homo sapiens; identical to SEQ ID NO: 535865
  misc_feature: HIJSMM301CKOOC.5.11.A11.1.454.light.4.raw

SEQ ID NO: 545211 - DNA, 509 bp, Homo sapiens; identical to SEQ ID NO: 541829
  misc_feature: HIJSMM301EDY7R.17.28.C06.1.454.light.4.raw

SEQ ID NO: 545212 - DNA, 487 bp, Homo sapiens
  misc_feature: HIJSMM301DRMSQ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtctagcagtatggtcacgtcccaagaacttttggccaggggaccaagctggagatcaaacgaactgtggctgcaccat

SEQ ID NO: 545213 - DNA, 479 bp, Homo sapiens
  misc_feature: HIJSMM301AH13I.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 545214 - DNA, 441 bp, Homo sapiens; identical to SEQ ID NO: 534971
  misc_feature: HIJSMM301B90AQ.11.3.A03.1.454.light.4.raw

SEQ ID NO: 545215 - DNA, 490 bp, Homo sapiens; identical to SEQ ID NO: 535234
  misc_feature: HIJSMM301EU6W9.17.21.B10.1.454.light.4.raw

SEQ ID NO: 545216 - DNA, 491 bp, Homo sapiens
  misc_feature: HIJSMM301D3G5C.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcc

SEQ ID NO: 545217 - DNA, 454 bp, Homo sapiens
  misc_feature: HIJSMM301B25F9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggttccggttttcggcggagggaccaagctgaccgtcctaagtcagcgcaaggctgccccctcggtcactctgttcccgccctcctcacgagagta

SEQ ID NO: 545218 - DNA, 520 bp, Homo sapiens; identical to SEQ ID NO: 537173
  misc_feature: HIJSMM301B52V3.27.23.C01.1.454.light.4.raw

SEQ ID NO: 545219 - DNA, 488 bp, Homo sapiens
  misc_feature: HIJSMM301BOM4B.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccacggggaccaagctggagatcaaacgaa

SEQ ID NO: 545220 - DNA, 444 bp, Homo sapiens
  misc_feature: HIJSMM301D99Y6.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccaccctcctcgacacgcgag

SEQ ID NO: 545221 - DNA, 484 bp, Homo sapiens; identical to SEQ ID NO: 535240
  misc_feature: HIJSMM301AEVPZ.47.60.F05.1.454.light.4.raw

SEQ ID NO: 545222 - DNA, 510 bp, Homo sapiens; identical to SEQ ID NO: 541797
  misc_feature: HIJSMM301ELVUX.15.34.D01.1.454.light.4.raw

SEQ ID NO: 545223 - DNA, 516 bp, Homo sapiens
  misc_feature: HIJSMM301B34ZS.16.46.E02.1.454.light.4.raw
  modified_base (252)..(252): a, c, t, g, unknown or other
tgtactactccacgaccggtgctcgatttagactcatctacagggaaagggggggatctcaggaggcagctctctcggaatatctccaccatggcctgggctctgctcctcctcaccctcctcactcaggcacaggagtcctgggctacgagtctgccctgactcagcctccctccgtgtccgggtctcctggacagtcagtcaccatctcctgcactggaaccagcagtgacgttggtagttataaccgtntcggggtcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctcg

SEQ ID NO: 545224 - DNA, 375 bp, Homo sapiens; identical to SEQ ID NO: 537938
  misc_feature: HIJSMM301DH7B2.9.11.A11.1.454.light.4.raw

SEQ ID NO: 545225 - DNA, 480 bp, Homo sapiens
  misc_feature: HIJSMM301C9Q8M.43.12.B01.1.454.light.4.raw
tgtgagtagtcacgaccggtgctcgatttagtagtgtagattccgcggggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagattttgccacttactattgtcaacaggctgacagtttccccttcaccttcggccaagggacacgactggacattaaacgaactgtggctgcacc

SEQ ID NO: 545226 - DNA, 474 bp, Homo sapiens
  misc_feature: HIJSMM301CYE29.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctactgtcttcggcactgggaccaaggtcaccgtcctaggtcagaccccg

SEQ ID NO: 545227 - DNA, 498 bp, Homo sapiens
  misc_feature: HIJSMM301A6ZJV.5.20.B09.1.454.light.4.raw
atcagacacgcacgaccggtgctcgatttagtgtagtgtgaagggggagctacaacaggcaggcaggggcagcaagatggtgttgcagacccaggtcttcatttctctgttgctctggatctctggtgcctgcgggggcatcgtgatgacccagtctccagactccctggctgtgtctctgggcgagagggccgccatcaactgcaagtccagccagaatattttatacagttccaataataagaactacttagcttggtaccaacagaaaccaggacagcctcctaagctgctcatttcctgggcgtctacccgggaatccggggtccctgaccgattcactggcagcgggtctgggacagatttcactctcaccatcgacagcctgcaggctgaggatgtggcagtttattactgtcagcaacattatagttcgtggacgttcggccaggggaccaaggtggaaatcaaacgaactgtggctgcaccatctgtctt

SEQ ID NO: 545228 - DNA, 521 bp, Homo sapiens; identical to SEQ ID NO: 538715
  misc_feature: HIJSMM301DA2JM.27.23.C01.1.454.light.4.raw

SEQ ID NO: 545229 - DNA, 495 bp, Homo sapiens
  misc_feature: HIJSMM301AUXRW.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaaggaccagggtggaaatcaaacgaactagtggctgcaccatctgtcttcatt

SEQ ID NO: 545230 - DNA, 497 bp, Homo sapiens; identical to SEQ ID NO: 537300
  misc_feature: HIJSMM301A3YZH.9.53.E09.1.454.light.4.raw

SEQ ID NO: 545231 - DNA, 490 bp, Homo sapiens
  misc_feature: HIJSMM301CGMKJ.4.22.B11.1.454.light.4.raw
agcactgtagcacgaccggtgctcgatttagacgacagctcagggggatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgcatgcaaggtacacactggccgtacacttttggccaggggaccaagctggagatcaacgaactgtggctgcaccat

SEQ ID NO: 545232 - DNA, 484 bp, Homo sapiens
  misc_feature: HIJSMM301ANQ0J.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtcgacgggaccgacggtggagtgtcaagcgaactgtggctgcaccat

SEQ ID NO: 545233 - DNA, 482 bp, Homo sapiens
  misc_feature: HIJSMM301CDNZ3.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcgaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatctgt

SEQ ID NO: 545234 - DNA, 481 bp, Homo sapiens
  misc_feature: HIJSMM301CTEGY.49.50.E06.1.454.light.4.raw
agtcgagagacacgaccggtgctcgatttagatctactgacaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactgtggctgca

SEQ ID NO: 545235 - DNA, 354 bp, Homo sapiens; identical to SEQ ID NO: 535026
  misc_feature: HIJSMM301EK3UP.19.22.B11.1.454.light.4.raw

SEQ ID NO: 545236 - DNA, 496 bp, Homo sapiens; identical to SEQ ID NO: 535597
  misc_feature: HIJSMM301BIGQO.22.20.B09.1.454.light.4.raw

SEQ ID NO: 545237 - DNA, 474 bp, Homo sapiens
  misc_feature: HIJSMM301B2RVY.51.53.E09.1.454.light.4.raw
cgatcgtatacacgaccggtgctcgatttagagagagtgtgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgca

SEQ ID NO: 545238 - DNA, 444 bp, Homo sapiens; identical to SEQ ID NO: 536685
  misc_feature: HIJSMM301C7ICO.10.76.G10.1.454.light.4.raw

SEQ ID NO: 545239 - DNA, 502 bp, Homo sapiens
  misc_feature: HIJSMM301A0K80.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggcctccgcgtggacgttcggccaagggaccaaggtggaaatacaaacgaactagtggctgcaccatctgtcttcta

SEQ ID NO: 545240 - DNA, 443 bp, Homo sapiens; identical to SEQ ID NO: 535475
  misc_feature: HIJSMM301CDEKZ.8.73.G07.1.454.light.4.raw

SEQ ID NO: 545241 - DNA, 513 bp, Homo sapiens
  misc_feature: HIJSMM301A9Q6Y.15.34.D01.1.454.light.4.raw
  modified_base (483)..(483): a, c, t, g, unknown or other
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtccctaggtcagcccaaggctgccccctccggtnactctgttcccaccctcctcgctacgtaga

SEQ ID NO: 545242 - DNA, 480 bp, Homo sapiens
  misc_feature: HIJSMM301DP9VS.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaacgaactgtgg

SEQ ID NO: 545243 - DNA, 472 bp, Homo sapiens; identical to SEQ ID NO: 535898
  misc_feature: HIJSMM301AZVU6.15.8.A08.1.454.light.4.raw

SEQ ID NO: 545244 - DNA, 509 bp, Homo sapiens
  misc_feature: HIJSMM301EJNRE.51.38.D05.1.454.light.4.raw
cgatcgtatacacgaccggtgctcgatttagtatctgatagttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtca

SEQ ID NO: 545245 - DNA, 494 bp, Homo sapiens; identical to SEQ ID NO: 534994
  misc_feature: HIJSMM301C7RGA.27.78.H01.1.454.light.4.raw

SEQ ID NO: 545246 - DNA, 494 bp, Homo sapiens
  misc_feature: HIJSMM301B8HBW.52.37.D04.1.454.light.4.raw
cgcagtacgacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctggtcagccaaggccaacccactgtcactcg

SEQ ID NO: 545247 - DNA, 485 bp, Homo sapiens; identical to SEQ ID NO: 535880
  misc_feature: HIJSMM301DUUMK.7.75.G09.1.454.light.4.raw

SEQ ID NO: 545248 - DNA, 485 bp, Homo sapiens; identical to SEQ ID NO: 538956
  misc_feature: HIJSMM301D6S42.40.69.G03.1.454.light.4.raw

SEQ ID NO: 545249 - DNA, 516 bp, Homo sapiens
  misc_feature: HIJSMM301AYF81.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccgacggaccgaacggtacggaaagtacaagacgaactacgtggtcgtgcgaccactctgtcttctactcttcccgt

SEQ ID NO: 545250 - DNA, 492 bp, Homo sapiens; identical to SEQ ID NO: 535126
  misc_feature: HIJSMM301B5XSX.18.11.A11.1.454.light.4.raw

SEQ ID NO: 545251 - DNA, 488 bp, Homo sapiens; identical to SEQ ID NO: 535568
  misc_feature: HIJSMM301D656M.21.4.A04.1.454.light.4.raw

SEQ ID NO: 545252 - DNA, 484 bp, Homo sapiens
  misc_feature: HIJSMM301AZEJA.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcactggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctg

SEQ ID NO: 545253 - DNA, 475 bp, Homo sapiens
  misc_feature: HIJSMM301BFK9E.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 545254 - DNA, 479 bp, Homo sapiens; identical to SEQ ID NO: 539241
  misc_feature: HIJSMM301BLPIP.21.25.C03.1.454.light.4.raw

SEQ ID NO: 545255 - DNA, 490 bp, Homo sapiens; identical to SEQ ID NO: 541407
  misc_feature: HIJSMM301A5DJQ.14.55.E11.1.454.light.4.raw

SEQ ID NO: 545256 - DNA, 497 bp, Homo sapiens; identical to SEQ ID NO: 536371
  misc_feature: HIJSMM301C6FDY.16.78.H01.1.454.light.4.raw

SEQ ID NO: 545257 - DNA, 495 bp, Homo sapiens; identical to SEQ ID NO: 537716
  misc_feature: HIJSMM301BS8CN.22.14.B03.1.454.light.4.raw

SEQ ID NO: 545258 - DNA, 494 bp, Homo sapiens
  misc_feature: HIJSMM301BU3RB.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgtaac

SEQ ID NO: 545259 - DNA, 505 bp, Homo sapiens
  misc_feature: HIJSMM301CWK0J.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctggtcagcccaaggctgccccctcggtcactctgttcccaccctcctcctacgtcgtat

SEQ ID NO: 545260 - DNA, 493 bp, Homo sapiens
  misc_feature: HIJSMM301BEL53.40.87.H10.1.454.light.4.raw
tctagcgactcacgaccggtgctcgatttagcagtactgcgttgggtttgggggagtcagacccactcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgagggtggaaagtacaaacgaactagtggctgcaccatctgtt

SEQ ID NO: 545261 - DNA, 484 bp, Homo sapiens
  misc_feature: HIJSMM301DWC7D.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 545262 - DNA, 494 bp, Homo sapiens; identical to SEQ ID NO: 534994
  misc_feature: HIJSMM301DO2JK.27.78.H01.1.454.light.4.raw

SEQ ID NO: 545263 - DNA, 505 bp, Homo sapiens
  misc_feature: HIJSMM301DHJ32.18.11.A11.1.454.light.4.raw
  modified_base (477)..(477): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaaatactatatcctcctctcacgttcggcggagggaccaaaggtggagatacaaacgaaactgtggctgcaccatctntcttccatcttcccggtccactctgata

SEQ ID NO: 545264 - DNA, 454 bp, Homo sapiens; identical to SEQ ID NO: 535005
  misc_feature: HIJSMM301AJYS6.19.86.H09.1.454.light.4.raw

SEQ ID NO: 545265 - DNA, 520 bp, Homo sapiens
  misc_feature: HIJSMM301BBDCA.16.66.F11.1.454.light.4.raw
tgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccgcctcctcgagtagtaca

SEQ ID NO: 545266 - DNA, 503 bp, Homo sapiens; identical to SEQ ID NO: 535140
  misc_feature: HIJSMM301AQE2M.18.37.D04.1.454.light.4.raw

SEQ ID NO: 545267 - DNA, 504 bp, Homo sapiens
  misc_feature: HIJSMM301DCZQV.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgacgtcctgggtcagcccaaggctcgccccctcggtcta

SEQ ID NO: 545268 - DNA, 447 bp, Homo sapiens; identical to SEQ ID NO: 535882
  misc_feature: HIJSMM301EMGEM.18.9.A09.1.454.light.4.raw
  modified_base (429)..(429): a, c, t, g, unknown or other

SEQ ID NO: 545269 - DNA, 485 bp, Homo sapiens
  misc_feature: HIJSMM301AZTEI.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagacctttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaagggtatagagcttcctccgacgttcggccaagggaccaaggtggaactcaacgaactgtggctgcaccatctgtcttcatcttcccgccatctgactagtctacg

SEQ ID NO: 545270 - DNA, 486 bp, Homo sapiens; identical to SEQ ID NO: 535043
  misc_feature: HIJSMM301AS7OR.46.35.D02.1.454.light.4.raw

SEQ ID NO: 545271 - DNA, 484 bp, Homo sapiens; identical to SEQ ID NO: 536162
  misc_feature: HIJSMM301CJ7CM.13.59.F04.1.454.light.4.raw

SEQ ID NO: 545272 - DNA, 506 bp, Homo sapiens
  misc_feature: HIJSMM301DW4QS.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtccgtgggcccagtctgttctgactcagccaccctcagcgtctcgggaccccgggcagagaatcaccatctcttgtactggaagcagctccaatatcggaagtaacgatgtcaattggtatcaacatctccccggtaccggcccccaaacctcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggacaagctgaccgtcctgggtcagcccaaggctgccccctcggtcact

SEQ ID NO: 545273 - DNA, 503 bp, Homo sapiens
  misc_feature: HIJSMM301CSDCI.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccctcctcg

SEQ ID NO: 545274 - DNA, 486 bp, Homo sapiens; identical to SEQ ID NO: 535385
  misc_feature: HIJSMM301AQBP0.19.71.G05.1.454.light.4.raw

SEQ ID NO: 545275 - DNA, 501 bp, Homo sapiens; identical to SEQ ID NO: 537545
  misc_feature: HIJSMM301A4PJQ.49.69.G03.1.454.light.4.raw

SEQ ID NO: 545276 - DNA, 457 bp, Homo sapiens
  misc_feature: HIJSMM301AWTCK.19.71.G05.1.454.light.4.raw
tactctcgtgcacgaccggtgctcgatttagtgtcgtcgcaagagagagggggcacttctccctctaacactctccccagtctccagactccctggctgtgtctctgggcgaggcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggatatcagacgaactgtggctgcaccatctgtcttcatcttcccgccatctgacacgagagta

SEQ ID NO: 545277 - DNA, 486 bp, Homo sapiens; identical to SEQ ID NO: 537428
  misc_feature: HIJSMM301DFA38.47.62.F07.1.454.light.4.raw

SEQ ID NO: 545278 - DNA, 508 bp, Homo sapiens
  misc_feature: HIJSMM301CRZSO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaagggaccgaaggtggaaagtacaaacgaactagtggctgcaccatctgtcttcatcttccccg

SEQ ID NO: 545279 - DNA, 487 bp, Homo sapiens; identical to SEQ ID NO: 536206
  misc_feature: HIJSMM301EA968.47.38.D05.1.454.light.4.raw

SEQ ID NO: 545280 - DNA, 496 bp, Homo sapiens
  misc_feature: HIJSMM301C1PKV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagccaagg

SEQ ID NO: 545281 - DNA, 489 bp, Homo sapiens; identical to SEQ ID NO: 535139
  misc_feature: HIJSMM301ATPOL.14.55.E11.1.454.light.4.raw

SEQ ID NO: 545282 - DNA, 494 bp, Homo sapiens; identical to SEQ ID NO: 539065
  misc_feature: HIJSMM301BUBUX.11.81.H04.1.454.light.4.raw

SEQ ID NO: 545283 - DNA, 482 bp, Homo sapiens; identical to SEQ ID NO: 536622
  misc_feature: HIJSMM301DPI0T.7.85.H08.1.454.light.4.raw

SEQ ID NO: 545284 - DNA, 495 bp, Homo sapiens
  misc_feature: HIJSMM301D5UIO.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggcgtctattattgcatgcaagcaacacactgccgtacacttttggccagggaccgaagctggagatcaatcgaactgtggtcg

SEQ ID NO: 545285 - DNA, 469 bp, Homo sapiens; identical to SEQ ID NO: 536091
  misc_feature: HIJSMM301EQV94.3.82.H05.1.454.light.4.raw

SEQ ID NO: 545286 - DNA, 501 bp, Homo sapiens
  misc_feature: HIJSMM301A4BDS.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccacaggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgaactgtggctgcaccatctgtcttcatcttccccg

SEQ ID NO: 545287 - DNA, 445 bp, Homo sapiens
  misc_feature: HIJSMM301DTU22.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcgggcggagggaccaagttgaccgtcctaagtcagcccaaggctgccccctcggtcactctgttcccgccctcctctgtcgagcgt

SEQ ID NO: 545288 - DNA, 507 bp, Homo sapiens; identical to SEQ ID NO: 535641
  misc_feature: HIJSMM301AJJ7V.10.88.H11.1.454.light.4.raw

SEQ ID NO: 545289 - DNA, 485 bp, Homo sapiens
  misc_feature: HIJSMM301EBTQ6.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtggatatcagacgaa

SEQ ID NO: 545290 - DNA, 514 bp, Homo sapiens
  misc_feature: HIJSMM301CF7ZA.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttccca

SEQ ID NO: 545291 - DNA, 497 bp, Homo sapiens
  misc_feature: HIJSMM301CX4YL.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactagtggctgcaccatctgtcttcat

SEQ ID NO: 545292 - DNA, 488 bp, Homo sapiens; identical to SEQ ID NO: 537260
  misc_feature: HIJSMM301CKCRN.47.70.G04.1.454.light.4.raw

SEQ ID NO: 545293 - DNA, 509 bp, Homo sapiens
  misc_feature: HIJSMM301A1GI9.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagccaaggctgccccctcggtccactctgttccc

SEQ ID NO: 545294 - DNA, 504 bp, Homo sapiens; identical to SEQ ID NO: 538940
  misc_feature: HIJSMM301DCBGG.2.35.D02.1.454.light.4.raw

SEQ ID NO: 545295 - DNA, 384 bp, Homo sapiens
  misc_feature: HIJSMM301BBYNN.49.27.C05.1.454.light.4.raw
agtcgagagacacgaccggtgctcgatttagacgcgatcgaagggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcaccatctgtcttcatcttcccgccatctgatctctcgact

SEQ ID NO: 545296 - DNA, 495 bp, Homo sapiens
  misc_feature: HIJSMM301ED8Y8.52.52.E08.1.454.light.4.raw
cgcagtacgacacgaccggtgctcgatttagtcgagctctcccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccactgtcactctcg

SEQ ID NO: 545297 - DNA, 444 bp, Homo sapiens; identical to SEQ ID NO: 534993
  misc_feature: HIJSMM301A2ZDL.5.9.A09.1.454.light.4.raw

SEQ ID NO: 545298 - DNA, 508 bp, Homo sapiens
  misc_feature: HIJSMM301D6COT.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 545299 - DNA, 480 bp, Homo sapiens
  misc_feature: HIJSMM301EIMVM.48.19.B08.1.454.light.4.raw
agtatacatacacgaccggtgctcgatttagtgagtcagtaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggcctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaa

SEQ ID NO: 545300 - DNA, 500 bp, Homo sapiens
  misc_feature: HIJSMM301EI2H6.43.53.E09.1.454.light.4.raw
tgtgagtagtcacgaccggtgctcgatttagagagagtgtgttgggtttgggggaagagctgctcagttaggacccagagggaaccatggaaaccccagcgcagcttctcttcctcctgctactctggctcccagataccaccggagaaattgtgttgacacagtctccaggcaccctgtctttgtctccaggggacagaggcaccctctcctgcagggccagtcagactgttagcagcagcagcttagcctggtaccagcagaaacctggccaggctcccaggctcctcatctatggtacatccaacagggccactggcataccagacaggttcagtggcagcgggtctgggacagacttcactctcaccatcagcagactggagcctgaagtatttgcaacttattactgtcaactagtttaataactaccctctcactttcggaggagggaccagggtggagatacaaacgaactgtggctgcacatctgtcttcta

SEQ ID NO: 545301 - DNA, 491 bp, Homo sapiens; identical to SEQ ID NO: 535294
  misc_feature: HIJSMM301BJ2GO.16.68.G02.1.454.light.4.raw

SEQ ID NO: 545302 - DNA, 484 bp, Homo sapiens
  misc_feature: HIJSMM301CH5N4.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaaggaccgaaggtggaaatcaaacgaactagtggctgcacca

SEQ ID NO: 545303 - DNA, 483 bp, Homo sapiens; identical to SEQ ID NO: 535317
  misc_feature: HIJSMM301CE3G3.4.1.A01.1.454.light.4.raw

SEQ ID NO: 545304 - DNA, 494 bp, Homo sapiens; identical to SEQ ID NO: 534992
  misc_feature: HIJSMM301ECUJC.9.1.A01.1.454.light.4.raw

SEQ ID NO: 545305 - DNA, 444 bp, Homo sapiens; identical to SEQ ID NO: 535192
  misc_feature: HIJSMM301CYYG1.5.9.A09.1.454.light.4.raw

SEQ ID NO: 545306 - DNA, 503 bp, Homo sapiens
  misc_feature: HIJSMM301AZ07H.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatctttcccgccta

SEQ ID NO: 545307 - DNA, 470 bp, Homo sapiens; identical to SEQ ID NO: 535302
  misc_feature: HIJSMM301EXEDD.13.76.G10.1.454.light.4.raw

SEQ ID NO: 545308 - DNA, 495 bp, Homo sapiens
  misc_feature: HIJSMM301DOW6Y.49.17.B06.1.454.light.4.raw
agtcgagagacacgaccggtgctcgatttagtcgatagtgaaggggggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgccat

SEQ ID NO: 545309 - DNA, 444 bp, Homo sapiens; identical to SEQ ID NO: 534993
  misc_feature: HIJSMM301DJUP0.5.9.A09.1.454.light.4.raw

SEQ ID NO: 545310 - DNA, 494 bp, Homo sapiens; identical to SEQ ID NO: 534994
  misc_feature: HIJSMM301A5X7C.27.78.H01.1.454.light.4.raw

SEQ ID NO: 545311 - DNA, 489 bp, Homo sapiens
  misc_feature: HIJSMM301CUPCC.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtccctcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcaccatctgtcttcatt

SEQ ID NO: 545312 - DNA, 505 bp, Homo sapiens
  misc_feature: HIJSMM301B9HVQ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaacgaactgtggctgcaccatctgtctt

SEQ ID NO: 545313 - DNA, 509 bp, Homo sapiens; identical to SEQ ID NO: 543772
  misc_feature: HIJSMM301CMNE3.2.21.B10.1.454.light.4.raw

SEQ ID NO: 545314 - DNA, 487 bp, Homo sapiens; identical to SEQ ID NO: 536206
  misc_feature: HIJSMM301AZ6CR.47.38.D05.1.454.light.4.raw

SEQ ID NO: 545315 - DNA, 497 bp, Homo sapiens
  misc_feature: HIJSMM301BK9EV.52.10.A10.1.454.light.4.raw
cgcagtacgacacgaccggtgctcgatttagcgtcgatctcagggggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaaacgaactgtggctgcaccatctgtcttcatctttccgccatctgata

SEQ ID NO: 545316 - DNA, 448 bp, Homo sapiens; identical to SEQ ID NO: 540364
  misc_feature: HIJSMM301AYIAL.18.9.A09.1.454.light.4.raw

SEQ ID NO: 545317 - DNA, 503 bp, Homo sapiens; identical to SEQ ID NO: 540136
  misc_feature: HIJSMM301DBUTC.19.10.A10.1.454.light.4.raw

SEQ ID NO: 545318 - DNA, 508 bp, Homo sapiens
  misc_feature: HIJSMM301BB4R6.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcgccggggaccgaccgtggaaatcaaacgaactagtggctgcaccatctgtctt

SEQ ID NO: 545319 - DNA, 488 bp, Homo sapiens; identical to SEQ ID NO: 537329
  misc_feature: HIJSMM301BASAA.26.23.C01.1.454.light.4.raw

SEQ ID NO: 545320 - DNA, 489 bp, Homo sapiens; identical to SEQ ID NO: 536013
  misc_feature: HIJSMM301DB477.26.23.C01.1.454.light.4.raw

SEQ ID NO: 545321 - DNA, 495 bp, Homo sapiens
  misc_feature: HIJSMM301AFL3N.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagtccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 545322 - DNA, 447 bp, Homo sapiens
  misc_feature: HIJSMM301CTQRT.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctggtaccaaggtcaccgtcctaagtcagcccaaggccaacccctctgtcactctgttcccgccctcctccatactcgta

SEQ ID NO: 545323 - DNA, 485 bp, Homo sapiens
  misc_feature: HIJSMM301CXFLA.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgaccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtggctgcaccat

SEQ ID NO: 545324 - DNA, 444 bp, Homo sapiens; identical to SEQ ID NO: 535594
  misc_feature: HIJSMM301BPJEC.9.9.A09.1.454.light.4.raw

SEQ ID NO: 545325 - DNA, 498 bp, Homo sapiens; identical to SEQ ID NO: 535974
  misc_feature: HIJSMM301DWMRL.22.27.C05.1.454.light.4.raw

SEQ ID NO: 545326 - DNA, 508 bp, Homo sapiens
  misc_feature: HIJSMM301D1SC5.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgtatactccgccgacgttcgccggggaccgaccgtcggaaatcaaacgaaactgtggctgcaccatctgtctt

SEQ ID NO: 545327 - DNA, 486 bp, Homo sapiens
  misc_feature: HIJSMM301CZUL1.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgccccc

SEQ ID NO: 545328 - DNA, 507 bp, Homo sapiens
  misc_feature: HIJSMM301DF0C6.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcta

SEQ ID NO: 545329 - DNA, 444 bp, Homo sapiens; identical to SEQ ID NO: 535594
  misc_feature: HIJSMM301D0QT3.9.9.A09.1.454.light.4.raw

SEQ ID NO: 545330 - DNA, 384 bp, Homo sapiens
  misc_feature: HIJSMM301EQPRJ.48.55.E11.1.454.light.4.raw
agtatacatacacgaccggtgctcgatttagcactcgcacgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 545331 - DNA, 487 bp, Homo sapiens; identical to SEQ ID NO: 538190
  misc_feature: HIJSMM301A7GQC.47.70.G04.1.454.light.4.raw

SEQ ID NO: 545332 - DNA, 506 bp, Homo sapiens; identical to SEQ ID NO: 535404
  misc_feature: HIJSMM301A8SPV.10.88.H11.1.454.light.4.raw

SEQ ID NO: 545333 - DNA, 495 bp, Homo sapiens; identical to SEQ ID NO: 535486
  misc_feature: HIJSMM301AXLJF.26.72.G06.1.454.light.4.raw

SEQ ID NO: 545334 - DNA, 503 bp, Homo sapiens; identical to SEQ ID NO: 535044
  misc_feature: HIJSMM301CYFHQ.19.78.H01.1.454.light.4.raw

SEQ ID NO: 545335 - DNA, 485 bp, Homo sapiens; identical to SEQ ID NO: 535606
  misc_feature: HIJSMM301C5KSS.47.46.E02.1.454.light.4.raw

SEQ ID NO: 545336 - DNA, 497 bp, Homo sapiens; identical to SEQ ID NO: 538296
  misc_feature: HIJSMM301A9XZL.18.11.A11.1.454.light.4.raw

SEQ ID NO: 545337 - DNA, 524 bp, Homo sapiens
  misc_feature: HIJSMM301BVAP5.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcggggaccaaagtgaccgtcctaagtcagccaaggctgccccctcggtcactctcgttcccaccccctt

SEQ ID NO: 545338 - DNA, 507 bp, Homo sapiens
  misc_feature: HIJSMM301B76FR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccaaggtggaaagtacaaacgaactagtggctgcaccatctgtcttctatcttcccg

SEQ ID NO: 545339 - DNA, 499 bp, Homo sapiens
  misc_feature: HIJSMM301B4EUS.48.45.E01.1.454.light.4.raw
agtatacatacacgaccggtgctcgatttagtgagtcagtaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagttacgtcggaccttcggccaagggacacgactggagattaaacgaactgtggctgcaccatctgtcttcatcttcccg

SEQ ID NO: 545340 - DNA, 453 bp, Homo sapiens
  misc_feature: HIJSMM301BLKJ2.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccaccctcctcacgagagta

SEQ ID NO: 545341 - DNA, 494 bp, Homo sapiens; identical to SEQ ID NO: 534994
  misc_feature: HIJSMM301EMUXX.27.78.H01.1.454.light.4.raw

SEQ ID NO: 545342 - DNA, 435 bp, Homo sapiens
  misc_feature: HIJSMM301BX5UC.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctgggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgtcttcatcttcccgccatctgacatactcgta

SEQ ID NO: 545343 - DNA, 484 bp, Homo sapiens
  misc_feature: HIJSMM301EJVM3.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccacggtggaatacaaacgaactagtggctgcaccatctgtctt

SEQ ID NO: 545344 - DNA, 489 bp, Homo sapiens
  misc_feature: HIJSMM301EGMRL.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 545345 - DNA, 447 bp, Homo sapiens; identical to SEQ ID NO: 535201
  misc_feature: HIJSMM301B55NI.18.9.A09.1.454.light.4.raw

SEQ ID NO: 545346 - DNA, 504 bp, Homo sapiens
  misc_feature: HIJSMM301CQQPP.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcaaggaccaacggtaggaagtacaagacgaactagtggtcgtcggcaccaactctgtcttc

SEQ ID NO: 545347 - DNA, 504 bp, Homo sapiens
  misc_feature: HIJSMM301CAGGI.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaacggacgacgactggagattaaaacg

SEQ ID NO: 545348 - DNA, 506 bp, Homo sapiens
  misc_feature: HIJSMM301CKWZX.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctgggaccaaggtggagatcaaacgaactgtggctgcaccatctgtcttcta

SEQ ID NO: 545349 - DNA, 493 bp, Homo sapiens
  misc_feature: HIJSMM301CAUT0.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaaatcgaactgtggctgcaccatctgtctt

SEQ ID NO: 545350 - DNA, 481 bp, Homo sapiens; identical to SEQ ID NO: 535993
  misc_feature: HIJSMM301D5Q35.21.25.C03.1.454.light.4.raw

SEQ ID NO: 545351 - DNA, 492 bp, Homo sapiens; identical to SEQ ID NO: 540272
  misc_feature: HIJSMM301BY758.41.23.C01.1.454.light.4.raw

SEQ ID NO: 545352 - DNA, 502 bp, Homo sapiens
  misc_feature: HIJSMM301B4QT9.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatactccccacctttcgtcccgtcggaccgaaacgtaggagtatacaaacgaaactaagtggtcgtcgcaccaactctgtt

SEQ ID NO: 545353 - DNA, 495 bp, Homo sapiens; identical to SEQ ID NO: 537415
  misc_feature: HIJSMM301EDFXI.4.27.C05.1.454.light.4.raw

SEQ ID NO: 545354 - DNA, 504 bp, Homo sapiens; identical to SEQ ID NO: 544677
  misc_feature: HIJSMM301C7HOW.7.71.G05.1.454.light.4.raw

SEQ ID NO: 545355 - DNA, 457 bp, Homo sapiens
  misc_feature: HIJSMM301BIG5A.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 545356 - DNA, 486 bp, Homo sapiens
  misc_feature: HIJSMM301C87SY.26.45.E01.1.454.light.4.raw
agactatactcacgaccggtgctcgatttagtgagtcagtaagggaaagggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcacttcgtcggagggaccgaaggtaggaggatacaaacgaac

SEQ ID NO: 545357 - DNA, 496 bp, Homo sapiens
  misc_feature: HIJSMM301BF32R.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcacca

SEQ ID NO: 545358 - DNA, 494 bp, Homo sapiens; identical to SEQ ID NO: 534992
  misc_feature: HIJSMM301D46QI.9.1.A01.1.454.light.4.raw

SEQ ID NO: 545359 - DNA, 485 bp, Homo sapiens
  misc_feature: HIJSMM301EULQN.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtcctaggtcagcccaaggctccg

SEQ ID NO: 545360 - DNA, 471 bp, Homo sapiens
  misc_feature: HIJSMM301DF3SQ.52.59.F04.1.454.light.4.raw
  modified_base (341)..(341): a, c, t, g, unknown or other
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcngtgggtctgggacagattttactctcaccatcagcagcctgcagcctgaagatgttgcaacttatttctgtcataactatgatgatgccctcacacgttcggccaagggaccaagctggaatcaaacgaa

SEQ ID NO: 545361 - DNA, 481 bp, Homo sapiens
  misc_feature: HIJSMM301EMLKB.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtctaggtcag

SEQ ID NO: 545362 - DNA, 489 bp, Homo sapiens
  misc_feature: HIJSMM301BAEW5.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttcccgccctcctccgtgagct

SEQ ID NO: 545363 - DNA, 495 bp, Homo sapiens
  misc_feature: HIJSMM301AKE7T.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaacggtggaaagtacaaacgaaactgtggctgcaccatctgtt

SEQ ID NO: 545364 - DNA, 496 bp, Homo sapiens
  misc_feature: HIJSMM301CNTDP.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggagtatcaaacgaactgtggctgcaccatctgtcttcatt

SEQ ID NO: 545365 - DNA, 533 bp, Homo sapiens
  misc_feature: HIJSMM301EPTLQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcgatagtcaaacgtacctacgttccgaacggacggaccgaacgtcggtaggagttaaaggtaacctaacggtaacggtcgttggcctaccgactccctagtcttcgtacttccttaccccg

SEQ ID NO: 545366 - DNA, 463 bp, Homo sapiens; identical to SEQ ID NO: 535062
  misc_feature: HIJSMM301C4T2B.11.73.G07.1.454.light.4.raw

SEQ ID NO: 545367 - DNA, 499 bp, Homo sapiens
  misc_feature: HIJSMM301BIOEN.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttccccgcctcctcgtatctctcg

SEQ ID NO: 545368 - DNA, 492 bp, Homo sapiens; identical to SEQ ID NO: 538317
  misc_feature: HIJSMM301DHS1B.10.17.B06.1.454.light.4.raw

SEQ ID NO: 545369 - DNA, 482 bp, Homo sapiens
  misc_feature: HIJSMM301DHXMN.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctatattgcatgcaagctctacaagtcccgctcactttcggcggaggaccaaggtggagatcaaacgaa

SEQ ID NO: 545370 - DNA, 353 bp, Homo sapiens; identical to SEQ ID NO: 536338
  misc_feature: HIJSMM301AFICU.3.11.A11.1.454.light.4.raw

SEQ ID NO: 545371 - DNA, 495 bp, Homo sapiens
  misc_feature: HIJSMM301DRSDT.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaacgaactgtggctgcaca

SEQ ID NO: 545372 - DNA, 463 bp, Homo sapiens; identical to SEQ ID NO: 535062
  misc_feature: HIJSMM301A2MDN.11.73.G07.1.454.light.4.raw

SEQ ID NO: 545373 - DNA, 496 bp, Homo sapiens
  misc_feature: HIJSMM301BI4WW.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcgaggcacagtattttacactagaaaatcagcagagtggaggctgaggatggttggggtttattactgcatgcaagctctacaaactccttactacttttggccgagggaccaagcgtggagatacaaacgaact

SEQ ID NO: 545374 - DNA, 493 bp, Homo sapiens; identical to SEQ ID NO: 535745
  misc_feature: HIJSMM301B0Q9O.47.78.H01.1.454.light.4.raw

SEQ ID NO: 545375 - DNA, 504 bp, Homo sapiens
  misc_feature: HIJSMM301CS60F.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccaccaccaacctgcaggctgaagatgtggcagtttattactgtcagcaatactatagtcctcctctcacgttcggcggagggaccaaggtggagatcaaacgaactgtggctgcaccatctgtcttcta

SEQ ID NO: 545376 - DNA, 495 bp, Homo sapiens
  misc_feature: HIJSMM301CMPFP.13.87.H10.1.454.light.4.raw
  modified_base (493)..(493): a, c, t, g, unknown or other
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaaatagttacccgcttcagttttcggcggagggaccaaggttggagaatccaaacgaactgtggcctgcaaccattcngt

SEQ ID NO: 545377 - DNA, 503 bp, Homo sapiens
  misc_feature: HIJSMM301A2SYR.43.35.D02.1.454.light.4.raw
tgtgagtagtcacgaccggtgctcgatttagcacacgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgcccccc

SEQ ID NO: 545378 - DNA, 489 bp, Homo sapiens; identical to SEQ ID NO: 535139
  misc_feature: HIJSMM301CNDMS.14.55.E11.1.454.light.4.raw

SEQ ID NO: 545379 - DNA, 503 bp, Homo sapiens
  misc_feature: HIJSMM301AZXGI.9.53.E09.1.454.light.4.raw
tgatacgtctcacgaccggtgctcgatttagagagagtgtgttgggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 545380 - DNA, 489 bp, Homo sapiens
  misc_feature: HIJSMM301ET4G8.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaaccagggaaagtccctaagctcctgatctatgttgcatccactttgcaaagtgggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgtcttcta

SEQ ID NO: 545381 - DNA, 509 bp, Homo sapiens
  misc_feature: HIJSMM301BXQBY.4.57.F02.1.454.light.4.raw
  modified_base (498)..(498): a, c, t, g, unknown or other
  modified_base (501)..(501): a, c, t, g, unknown or other
  modified_base (504)..(504): a, c, t, g, unknown or other
agcactgtagcacgaccggtgctcgatttagctcgatatagttgggtttggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggaccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccaccacgtnacnctntccta

SEQ ID NO: 545382 - DNA, 511 bp, Homo sapiens
  misc_feature: HIJSMM301C4Q9R.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgtggcatttgggtgttcggcggagggaccaaactgaccgtcctaggtcagcccaaggctgccccctcggtcactctgttcccgccctcctcgctacgtaga

SEQ ID NO: 545383 - DNA, 486 bp, Homo sapiens; identical to SEQ ID NO: 544919
  misc_feature: HIJSMM301ATP0X.7.85.H08.1.454.light.4.raw

SEQ ID NO: 545384 - DNA, 493 bp, Homo sapiens
  misc_feature: HIJSMM301CBN70.49.87.H10.1.454.light.4.raw
agtcgagagacacgaccggtgctcgatttagcagtactgcgttggggtttgggggagggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctccccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacactttcggcggagggaccaaggtggagatacaaacgaactgtggctgcaccat

SEQ ID NO: 545385 - DNA, 498 bp, Homo sapiens; identical to SEQ ID NO: 535974
  misc_feature: HIJSMM301AI0XE.22.27.C05.1.454.light.4.raw

SEQ ID NO: 545386 - DNA, 507 bp, Homo sapiens; identical to SEQ ID NO: 535641
  misc_feature: HIJSMM301ASWSQ.10.88.H11.1.454.light.4.raw

SEQ ID NO: 545387 - DNA, 462 bp, Homo sapiens
  misc_feature: HIJSMM301APOTJ.49.10.A10.1.454.light.4.raw
agtcgagagacacgaccggtgctcgatttagcgtcgatctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaa

SEQ ID NO: 545388 - DNA, 494 bp, Homo sapiens; identical to SEQ ID NO: 534992
  misc_feature: HIJSMM301AIPTS.9.1.A01.1.454.light.4.raw

SEQ ID NO: 545389 - DNA, 486 bp, Homo sapiens; identical to SEQ ID NO: 537617
  misc_feature: HIJSMM301A2S1X.10.53.E09.1.454.light.4.raw

SEQ ID NO: 545390 - DNA, 446 bp, Homo sapiens; identical to SEQ ID NO: 538439
  misc_feature: HIJSMM301DNEMP.18.9.A09.1.454.light.4.raw

SEQ ID NO: 545391 - DNA, 504 bp, Homo sapiens
  misc_feature: HIJSMM301EEKVC.12.67.G01.1.454.light.4.raw
atacgacgtacacgaccggtgctcgatttagagtatacatattgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgcttcggaagtgggaccaaggtcaccgtcctacgtcagcccaaggcccaacccca

SEQ ID NO: 545392 - DNA, 454 bp, Homo sapiens; identical to SEQ ID NO: 534964
  misc_feature: HIJSMM301ANKIW.19.86.H09.1.454.light.4.raw

SEQ ID NO: 545393 - DNA, 481 bp, Homo sapiens
  misc_feature: HIJSMM301BRLH1.48.10.A10.1.454.light.4.raw
agtatacatacacgaccggtgctcgatttagcgtcgatctcaggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttattctgccaacagtatcatacttattctcggaccttcggcctaagggaccaggtggaaatcaaacgaactacgtggctgcaccat

SEQ ID NO: 545394 - DNA, 444 bp, Homo sapiens; identical to SEQ ID NO: 535594
  misc_feature: HIJSMM301AYJ77.9.9.A09.1.454.light.4.raw

SEQ ID NO: 545395 - DNA, 502 bp, Homo sapiens
  misc_feature: HIJSMM301CTEM1.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccaccctcc

SEQ ID NO: 545396 - DNA, 489 bp, Homo sapiens; identical to SEQ ID NO: 535402
  misc_feature: HIJSMM301B3K4S.11.12.B01.1.454.light.4.raw

SEQ ID NO: 545397 - DNA, 488 bp, Homo sapiens; identical to SEQ ID NO: 536742
  misc_feature: HIJSMM301DG44M.3.72.G06.1.454.light.4.raw

SEQ ID NO: 545398 - DNA, 516 bp, Homo sapiens
  misc_feature: HIJSMM301DZA6S.48.17.B06.1.454.light.4.raw
agtatacatacacgaccggtgctcgatttagtcgatagtgaagggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccaccct

SEQ ID NO: 545399 - DNA, 504 bp, Homo sapiens; identical to SEQ ID NO: 540089
  misc_feature: HIJSMM301CV19M.3.53.E09.1.454.light.4.raw

SEQ ID NO: 545400 - DNA, 516 bp, Homo sapiens; identical to SEQ ID NO: 536439
  misc_feature: HIJSMM301EQTG8.14.66.F11.1.454.light.4.raw

SEQ ID NO: 545401 - DNA, 497 bp, Homo sapiens
  misc_feature: HIJSMM301D4Z81.41.14.B03.1.454.light.4.raw
tctatactatcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtctaggtcagcccaaggctcg

SEQ ID NO: 545402 - DNA, 480 bp, Homo sapiens
  misc_feature: HIJSMM301CB6YG.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtaggaaatacaaacgaactagtggctgca

SEQ ID NO: 545403 - DNA, 486 bp, Homo sapiens
  misc_feature: HIJSMM301BTWMS.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgaccctcctcgctacgtaga

SEQ ID NO: 545404 - DNA, 481 bp, Homo sapiens
  misc_feature: HIJSMM301EM6N2.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctcactgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccatcactttcggcggagggaccaaggtcgagatcaaacgaactgtggctgcaccatct

SEQ ID NO: 545405 - DNA, 472 bp, Homo sapiens
  misc_feature: HIJSMM301DQ4DG.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaacgaa

SEQ ID NO: 545406 - DNA, 383 bp, Homo sapiens; identical to SEQ ID NO: 447524
  misc_feature: HIJSMM301BHJGK.41.26.C04.1.454.light.4.raw

SEQ ID NO: 545407 - DNA, 478 bp, Homo sapiens
  misc_feature: HIJSMM301D5F7H.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttactttgtcaacaggctcagagtttcccgctcactttcggcggagggaccaaggtggagatcaaacgaactgtggctgca

SEQ ID NO: 545408 - DNA, 513 bp, Homo sapiens
  misc_feature: HIJSMM301BZ7RE.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattcccgggacagcagtgctaacccaattatgtcttcggaactgggaccaaggtcacgtcctaggtcagcccaaggccaaccca

SEQ ID NO: 545409 - DNA, 519 bp, Homo sapiens
  misc_feature: HIJSMM301A83HB.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacggaccgaacggtaggaagtacaaacgaactagtggctgcaccatctgtcttctactcttcccgccactctgact

SEQ ID NO: 545410 - DNA, 515 bp, Homo sapiens; identical to SEQ ID NO: 541619
  misc_feature: HIJSMM301B3WDV.10.86.H09.1.454.light.4.raw

SEQ ID NO: 545411 - DNA, 485 bp, Homo sapiens; identical to SEQ ID NO: 535606
  misc_feature: HIJSMM301EZSJ8.47.46.E02.1.454.light.4.raw

SEQ ID NO: 545412 - DNA, 444 bp, Homo sapiens; identical to SEQ ID NO: 536484
  misc_feature: HIJSMM301EQAYP.8.11.A11.1.454.light.4.raw

SEQ ID NO: 545413 - DNA, 483 bp, Homo sapiens
  misc_feature: HIJSMM301AYLYR.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcaccatctgtt

SEQ ID NO: 545414 - DNA, 499 bp, Homo sapiens
  misc_feature: HIJSMM301DL8MM.48.67.G01.1.454.light.4.raw
agtatacatacacgaccggtgctcgatttagagtatacatattgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttatactgtcagcagcgtgccaactggcctctcacgttcggcggagggaccaaggtggacatcaaacgactgtggctgcaccatctgtcttcatcttcccg

SEQ ID NO: 545415 - DNA, 383 bp, Homo sapiens; identical to SEQ ID NO: 447524
  misc_feature: HIJSMM301CVTAE.41.26.C04.1.454.light.4.raw

SEQ ID NO: 545416 - DNA, 511 bp, Homo sapiens
  misc_feature: HIJSMM301EDVWL.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtcccgtcgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctc

SEQ ID NO: 545417 - DNA, 503 bp, Homo sapiens
  misc_feature: HIJSMM301CDW61.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagtggccctcgggggtccctgatcgcttctctggctccaagtctggcaacacggcctccctgaccatctctgggctccaggctgaagatcaggctgattattactgctgttcattttcaagttccttttttgtcttcggaactgggaccgaggtcaccgtcctaggtcagcccaaggccaacccactgtca

SEQ ID NO: 545418 - DNA, 497 bp, Homo sapiens; identical to SEQ ID NO: 535664
  misc_feature: HIJSMM301BTE6W.22.14.B03.1.454.light.4.raw

SEQ ID NO: 545419 - DNA, 494 bp, Homo sapiens; identical to SEQ ID NO: 534992
  misc_feature: HIJSMM301BNZVE.9.1.A01.1.454.light.4.raw

SEQ ID NO: 545420 - DNA, 472 bp, Homo sapiens; identical to SEQ ID NO: 536302
  misc_feature: HIJSMM301D3DNG.18.76.G10.1.454.light.4.raw

SEQ ID NO: 545421 - DNA, 381 bp, Homo sapiens
  misc_feature: HIJSMM301BXF9D.41.26.C04.1.454.light.4.raw
tctatactatcacgaccggtgctcgatttagtctagcgactttgggtttggggaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcattctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 545422 - DNA, 492 bp, Homo sapiens
  misc_feature: HIJSMM301BS0IQ.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtacatcgtcttcggaactgggaccaaggtcaccgtccg

SEQ ID NO: 545423 - DNA, 514 bp, Homo sapiens
  misc_feature: HIJSMM301APE7I.17.33.C11.1.454.light.4.raw
  modified_base (510)..(510): a, c, t, g, unknown or other
cgtagactagcacgaccggtgctcgatttagagtgagctcgttgggtttgggggcgccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcccncctt

SEQ ID NO: 545424 - DNA, 514 bp, Homo sapiens
  misc_feature: HIJSMM301BW0YN.10.28.C06.1.454.light.4.raw
catagtagtgcacgaccggtgctcgatttagagctcacgtattgggtttgggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacactgaccgtcctaggtcagcccaaggctgccccctcggtcactctgtt

SEQ ID NO: 545425 - DNA, 496 bp, Homo sapiens; identical to SEQ ID NO: 537925
  misc_feature: HIJSMM301BMEJ3.22.14.B03.1.454.light.4.raw

SEQ ID NO: 545426 - DNA, 490 bp, Homo sapiens; identical to SEQ ID NO: 541141
  misc_feature: HIJSMM301EO5LM.47.38.D05.1.454.light.4.raw

SEQ ID NO: 545427 - DNA, 484 bp, Homo sapiens; identical to SEQ ID NO: 540581
  misc_feature: HIJSMM301CMY2X.3.88.H11.1.454.light.4.raw

SEQ ID NO: 545428 - DNA, 492 bp, Homo sapiens; identical to SEQ ID NO: 535426
  misc_feature: HIJSMM301EPU1D.47.78.H01.1.454.light.4.raw

SEQ ID NO: 545429 - DNA, 489 bp, Homo sapiens; identical to SEQ ID NO: 535139
  misc_feature: HIJSMM301CTV9X.14.55.E11.1.454.light.4.raw

SEQ ID NO: 545430 - DNA, 507 bp, Homo sapiens
  misc_feature: HIJSMM301CPOW3.14.57.F02.1.454.light.4.raw
cgtctagtaccacgaccggtgctcgatttagctcgatatagttgggtttggggagggaactgctcagttaggacccacgagggaaccgatggaagccccacgctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcgggcgggggaccaaggtggagttcaaacgaactgtggctgcaccatctgtcttcactcttcccg

SEQ ID NO: 545431 - DNA, 489 bp, Homo sapiens; identical to SEQ ID NO: 536663
  misc_feature: HIJSMM301DFHQF.16.72.G06.1.454.light.4.raw

SEQ ID NO: 545432 - DNA, 496 bp, Homo sapiens; identical to SEQ ID NO: 536690
  misc_feature: HIJSMM301A11DZ.40.23.C01.1.454.light.4.raw

SEQ ID NO: 545433 - DNA, 454 bp, Homo sapiens
  misc_feature: HIJSMM301CI3SH.5.86.H09.1.454.light.4.raw
atcagacacgcacgaccggtgctcgatttagtgctatagacttgggtttggggggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcactctgttcccaccctcctccggtctgat

SEQ ID NO: 545434 - DNA, 493 bp, Homo sapiens; identical to SEQ ID NO: 535047
  misc_feature: HIJSMM301BTLHZ.16.53.E09.1.454.light.4.raw

SEQ ID NO: 545435 - DNA, 496 bp, Homo sapiens; identical to SEQ ID NO: 535109
  misc_feature: HIJSMM301ANJMV.16.78.H01.1.454.light.4.raw

SEQ ID NO: 545436 - DNA, 478 bp, Homo sapiens; identical to SEQ ID NO: 535449
  misc_feature: HIJSMM301AJ2HG.40.59.F04.1.454.light.4.raw

SEQ ID NO: 545437 - DNA, 485 bp, Homo sapiens
  misc_feature: HIJSMM301EEUUY.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggttctaatcgggcctccggggtccctgacaggttcagtggcagtggatcaggcacagattttacactagaaaatcagcagagtggaggctgaggatgttgggctctattattgcatgcaagctctacaagtcccgctcactttcggcggagggaccaaggtggagatacaaacgaa

SEQ ID NO: 545438 - DNA, 516 bp, Homo sapiens
  misc_feature: HIJSMM301AIAO3.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggctgccccctcggtcactctgttcccaccctcctccacg

SEQ ID NO: 545439 - DNA, 509 bp, Homo sapiens
  misc_feature: HIJSMM301BHXFH.41.41.D08.1.454.light.4.raw
tctatactatcacgaccggtgctcgatttagtcacgcgagaaagggaaagggggcttcagctgtgggtagagaagacaggactcaggacaatctccagcatggccagcttccctctcctcctcaccctcctcactcactgtgcagggtcctgggcccagtctgtgctgactcagtcaccctctgcgtctgggacccccgggcagagggtcaccatgtattgtgctgggagcaggtccaacatcggacgtaatactgtgagttggtatcagcaagtcccaggaacggccccaaactcctcgtttctggaaacaatcagcggccctcaggagtccctgagcgattctctggctccaagtctggcacctcagcctccctggccatcagagggctccagtccgaggatgagggtgtttattattgtgcagtctgggatgacagtctgaatggtcattgggtgttcggcggagggaccaagttgaccgtctaggtcagcccaggctgccccctc

SEQ ID NO: 545440 - DNA, 499 bp, Homo sapiens
  misc_feature: HIJSMM301A8UFE.10.68.G02.1.454.light.4.raw
catagtagtgcacgaccggtgctcgattagtcgatagtgaagggaaagggggtgtgggctcaggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaacaaaatatgcttattggtacgagcaaaagccaggccaggcccctgtcttgttgatatatgaggacaccaagcgaccctccggaatttctgagagattctccggctccagctcagggacagtggcctccttgactatcagtgggcccagggggtcgatgaggctgactactactgtttctcgactgacttcactggtaaacgttggctgttcggcggagggaccaagctgaccgtcctgcgtcagcccaaggctgccccctcggtcactc

SEQ ID NO: 545441 - DNA, 382 bp, Homo sapiens
  misc_feature: HIJSMM301DEHN0.41.33.C11.1.454.light.4.raw
tctatactatcacgaccggtgctcgatttagagtgagctcgttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 545442 - DNA, 488 bp, Homo sapiens; identical to SEQ ID NO: 541868
  misc_feature: HIJSMM301EL7VA.14.55.E11.1.454.light.4.raw

SEQ ID NO: 545443 - DNA, 516 bp, Homo sapiens
  misc_feature: HIJSMM301DACFS.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctgggactgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttccccgccctcctcgctacgtagac

SEQ ID NO: 545444 - DNA, 480 bp, Homo sapiens
  misc_feature: HIJSMM301B11J5.40.85.H08.1.454.light.4.raw
tctagcgactcacgaccggtgctcgatttagtatcactcagtcgcgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaaatgaattagcctggtttcagcagaaaccagggaaagcccctaagctcctgatctatgctgcatccactttagaaaatggggtcccatcaagattcagcggcagtggatctggcacagatttcactctcaccgtcagcagcctgcagtctgaagattttgcaacttattactgtctacaagattataattaccctcggacgttcggtccagggaccgaaggtggatgtcaagacgaactagtggcgtgca

SEQ ID NO: 545445 - DNA, 510 bp, Homo sapiens; identical to SEQ ID NO: 545115
  misc_feature: HIJSMM301B9RE0.19.59.F04.1.454.light.4.raw

SEQ ID NO: 545446 - DNA, 499 bp, Homo sapiens; identical to SEQ ID NO: 536578
  misc_feature: HIJSMM301BI19H.22.27.C05.1.454.light.4.raw

SEQ ID NO: 545447 - DNA, 490 bp, Homo sapiens
  misc_feature: HIJSMM301BR8MV.4.40.D07.1.454.light.4.raw
agcactgtagcacgaccggtgctcgatttagtgatagagcgtaacaacagagggggctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtgggcgcgcgttttcggcgggggaccgaaggtggacgatcaaacgaactgtggctgcaccatctgtctt

SEQ ID NO: 545448 - DNA, 492 bp, Homo sapiens
  misc_feature: HIJSMM301BIZLR.40.37.D04.1.454.light.4.raw
tctagcgactcacgaccggtgctcgatttagtagcatactgttgggtttggggtgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttatacctttcctcggactttcggccctcggaccgacgagtggatgtcaaacgaaactac

SEQ ID NO: 545449 - DNA, 486 bp, Homo sapiens; identical to SEQ ID NO: 535385
  misc_feature: HIJSMM301E0BBI.19.71.G05.1.454.light.4.raw

SEQ ID NO: 545450 - DNA, 491 bp, Homo sapiens
  misc_feature: HIJSMM301BW4O9.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgatcaccttcggccaacggacgacgactggagattaaacgaactgtggctgcaccatctgtcttcat

SEQ ID NO: 545451 - DNA, 454 bp, Homo sapiens; identical to SEQ ID NO: 536347
  misc_feature: HIJSMM301C5QCV.19.86.H09.1.454.light.4.raw

SEQ ID NO: 545452 - DNA, 490 bp, Homo sapiens; identical to SEQ ID NO: 535064
  misc_feature: HIJSMM301AOSIW.10.72.G06.1.454.light.4.raw

SEQ ID NO: 545453 - DNA, 449 bp, Homo sapiens
  misc_feature: HIJSMM301C9S1L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaaggccaacccctctgtcactctgttcccaaccctcctccatactcgta

SEQ ID NO: 545454 - DNA, 513 bp, Homo sapiens; identical to SEQ ID NO: 535719
  misc_feature: HIJSMM301AKPB0.17.33.C11.1.454.light.4.raw

SEQ ID NO: 545455 - DNA, 447 bp, Homo sapiens; identical to SEQ ID NO: 535201
  misc_feature: HIJSMM301EG6HU.18.9.A09.1.454.light.4.raw

SEQ ID NO: 545456 - DNA, 490 bp, Homo sapiens; identical to SEQ ID NO: 535234
  misc_feature: HIJSMM301AJILP.17.21.B10.1.454.light.4.raw

SEQ ID NO: 545457 - DNA, 487 bp, Homo sapiens
  misc_feature: HIJSMM301AWKAS.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccacttttcggccctgggaccatagtggatatagaacgaactgtggctgcacc

SEQ ID NO: 545458 - DNA, 447 bp, Homo sapiens; identical to SEQ ID NO: 535201
  misc_feature: HIJSMM301DQQZ2.18.9.A09.1.454.light.4.raw

SEQ ID NO: 545459 - DNA, 497 bp, Homo sapiens; identical to SEQ ID NO: 536376
  misc_feature: HIJSMM301BMUI9.22.9.A09.1.454.light.4.raw

SEQ ID NO: 545460 - DNA, 487 bp, Homo sapiens; identical to SEQ ID NO: 541889
  misc_feature: HIJSMM301EHXVC.26.23.C01.1.454.light.4.raw

SEQ ID NO: 545461 - DNA, 481 bp, Homo sapiens
  misc_feature: HIJSMM301AFD4X.48.37.D04.1.454.light.4.raw
agtatacatacacgaccggtgctcgatttagtagcatactgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagacccaac

SEQ ID NO: 545462 - DNA, 498 bp, Homo sapiens
  misc_feature: HIJSMM301CSAWD.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcacatctgtcttcatt

SEQ ID NO: 545463 - DNA, 488 bp, Homo sapiens; identical to SEQ ID NO: 540982
  misc_feature: HIJSMM301C5SDP.8.4.A04.1.454.light.4.raw

SEQ ID NO: 545464 - DNA, 501 bp, Homo sapiens
  misc_feature: HIJSMM301B43HB.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcaggaccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccgaaggtggagatcaagcgaactgtggctgcaccatctgtcttcatcttcccgtcca

SEQ ID NO: 545465 - DNA, 478 bp, Homo sapiens
  misc_feature: HIJSMM301A6WL4.48.55.E11.1.454.light.4.raw
agtatacatacacgaccggtgctcgatttagcactcgcacgttgggtttgggggcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcaccatctgtcttcatcttcccgccatctgatatgtata

SEQ ID NO: 545466 - DNA, 476 bp, Homo sapiens; identical to SEQ ID NO: 538611
  misc_feature: HIJSMM301BS6RD.7.81.H04.1.454.light.4.raw

SEQ ID NO: 545467 - DNA, 500 bp, Homo sapiens
  misc_feature: HIJSMM301AOEE1.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgaggggggggctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtca

SEQ ID NO: 545468 - DNA, 486 bp, Homo sapiens; identical to SEQ ID NO: 535043
  misc_feature: HIJSMM301DRUF7.46.35.D02.1.454.light.4.raw

SEQ ID NO: 545469 - DNA, 513 bp, Homo sapiens
  misc_feature: HIJSMM301C9U1W.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcga

SEQ ID NO: 545470 - DNA, 496 bp, Homo sapiens
  misc_feature: HIJSMM301C5OBJ.51.47.E03.1.454.light.4.raw
cgatcgtatacacgaccggtgctcgatttagactcgcgcacagagagaagggggggtccgaggaggcagaactctgggtgtctcaccatggcctggatccctctacttctccccctccctcactctctgcacaggctctgaggcctcctatgagctgacacagccaccctcggtgtcagtgtccccaggacagacggccgggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 545471 - DNA, 502 bp, Homo sapiens
  misc_feature: HIJSMM301BJRWL.19.67.G01.1.454.light.4.raw
tactctcgtgcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctcc

SEQ ID NO: 545472 - DNA, 488 bp, Homo sapiens
  misc_feature: HIJSMM301DVCKX.4.27.C05.1.454.light.4.raw
agcactgtagcacgaccggtgctcgatttagacgcgatcgaagggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgtgg

SEQ ID NO: 545473 - DNA, 484 bp, Homo sapiens
  misc_feature: HIJSMM301BV86Q.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggacagggtcaccgtccaggtcagcccaaggccaaccca

SEQ ID NO: 545474 - DNA, 494 bp, Homo sapiens
  misc_feature: HIJSMM301ALE81.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcgcggagggaccgagggtggaggatcagacgaactgtgggctg

SEQ ID NO: 545475 - DNA, 433 bp, Homo sapiens; identical to SEQ ID NO: 535337
  misc_feature: HIJSMM301C6ZOO.18.5.A05.1.454.light.4.raw

SEQ ID NO: 545476 - DNA, 503 bp, Homo sapiens; identical to SEQ ID NO: 543658
  misc_feature: HIJSMM301ALNT9.4.71.G05.1.454.light.4.raw

SEQ ID NO: 545477 - DNA, 481 bp, Homo sapiens
  misc_feature: HIJSMM301DJDDP.48.55.E11.1.454.light.4.raw
agtatacatacacgaccggtgctcgatttagcactcgcacgttgggtttggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaaggaccaggtaggaagtcaacgaactagtgctgcaccta

SEQ ID NO: 545478 - DNA, 484 bp, Homo sapiens
  misc_feature: HIJSMM301EOL3R.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacacagcgtggtgttcggcggagggaccagtctgaccgtctaggtcagccc

SEQ ID NO: 545479 - DNA, 484 bp, Homo sapiens; identical to SEQ ID NO: 535400
  misc_feature: HIJSMM301BYY66.46.26.C04.1.454.light.4.raw

SEQ ID NO: 545480 - DNA, 512 bp, Homo sapiens; identical to SEQ ID NO: 541300
  misc_feature: HIJSMM301B2NAM.17.33.C11.1.454.light.4.raw

SEQ ID NO: 545481 - DNA, 489 bp, Homo sapiens
  misc_feature: HIJSMM301EHUSL.17.25.C03.1.454.light.4.raw
cgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaaatctactactgtcaacagagttacagttcccctcgcacttttggccaggggaccaaagttgagatcaaacgaactgtggctgcaccatctgt

SEQ ID NO: 545482 - DNA, 502 bp, Homo sapiens
  misc_feature: HIJSMM301DGJHM.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggtccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 545483 - DNA, 496 bp, Homo sapiens; identical to SEQ ID NO: 535109
  misc_feature: HIJSMM301DKQC5.16.78.H01.1.454.light.4.raw

SEQ ID NO: 545484 - DNA, 447 bp, Homo sapiens; identical to SEQ ID NO: 535201
  misc_feature: HIJSMM301DMZNB.18.9.A09.1.454.light.4.raw

SEQ ID NO: 545485 - DNA, 497 bp, Homo sapiens; identical to SEQ ID NO: 538296
  misc_feature: HIJSMM301A0NIC.18.11.A11.1.454.light.4.raw

SEQ ID NO: 545486 - DNA, 470 bp, Homo sapiens
  misc_feature: HIJSMM301DC732.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtggacagcagcactgcccgctatgtcttcggaactggaccaaggtcacgtcctaagtcagccc

SEQ ID NO: 545487 - DNA, 383 bp, Homo sapiens; identical to SEQ ID NO: 540698
  misc_feature: HIJSMM301AR8QJ.41.28.C06.1.454.light.4.raw

SEQ ID NO: 545488 - DNA, 447 bp, Homo sapiens; identical to SEQ ID NO: 535020
  misc_feature: HIJSMM301DHQGF.18.9.A09.1.454.light.4.raw

SEQ ID NO: 545489 - DNA, 489 bp, Homo sapiens; identical to SEQ ID NO: 535139
  misc_feature: HIJSMM301CQKV9.14.55.E11.1.454.light.4.raw

SEQ ID NO: 545490 - DNA, 489 bp, Homo sapiens
  misc_feature: HIJSMM301A0FI3.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggtaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccatctgtt

SEQ ID NO: 545491 - DNA, 504 bp, Homo sapiens; identical to SEQ ID NO: 535561
  misc_feature: HIJSMM301DKH5T.4.57.F02.1.454.light.4.raw

SEQ ID NO: 545492 - DNA, 488 bp, Homo sapiens
  misc_feature: HIJSMM301D16VC.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccaaggtaggagtaatcagacgaa

SEQ ID NO: 545493 - DNA, 525 bp, Homo sapiens
  misc_feature: HIJSMM301ATR2Q.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggtactgtccccaaactcattctttatgatgtcagtaatcggcccccaggggtttctgatcgcttctatggctccaagtctgcctacacggcctccctgaccatctccgggctccagccctgaggacgaggctgattattattgtagttcatatacaaccagtgacacttgggtgttcggcggagggaccaggctgaccgtcctaggtcagcccaaggctgccccctcggtcactctgttcccgccctcct

SEQ ID NO: 545494 - DNA, 476 bp, Homo sapiens
  misc_feature: HIJSMM301C707J.51.76.G10.1.454.light.4.raw
cgatcgtatacacgaccggtgctcgatttagtcactcatacaggggggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagatttgcaatttattactgtcagcagtataataactggcctcgtacacttttggccaggggaccaagctggagatcaaacgaactgtggctgcacc

SEQ ID NO: 545495 - DNA, 495 bp, Homo sapiens
  misc_feature: HIJSMM301CI5NY.51.29.C07.1.454.light.4.raw
cgatcgtatacacgaccggtgctcgatttagagtgctacgaagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgctgctcacatgcaggcagcatcggtgtgctattcggcgagggaccaagctgaccgtctaggtcagcccaaggctcg

SEQ ID NO: 545496 - DNA, 503 bp, Homo sapiens
  misc_feature: HIJSMM301B5CZY.8.24.C02.1.454.light.4.raw
ctcgcgtgtccacgaccggtgctcgatttagtacagatcgttagggaaagggggggtctcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 545497 - DNA, 484 bp, Homo sapiens; identical to SEQ ID NO: 535400
  misc_feature: HIJSMM301A059L.46.26.C04.1.454.light.4.raw

SEQ ID NO: 545498 - DNA, 494 bp, Homo sapiens; identical to SEQ ID NO: 534994
  misc_feature: HIJSMM301C76NX.27.78.H01.1.454.light.4.raw

SEQ ID NO: 545499 - DNA, 517 bp, Homo sapiens; identical to SEQ ID NO: 541566
  misc_feature: HIJSMM301AYCL5.22.30.C08.1.454.light.4.raw

SEQ ID NO: 545500 - DNA, 511 bp, Homo sapiens
  misc_feature: HIJSMM301D98AY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggccaaggaccgaacggtaggaagtacaaacgaactagtggcgtgcaccactctgtcttctatcttcccgccact

SEQ ID NO: 545501 - DNA, 495 bp, Homo sapiens
  misc_feature: HIJSMM301DOIK4.22.14.B03.1.454.light.4.raw
acatacgcgtcacgaccggtgctcgatttagtgtgagtagttccgcgggggagctacaacagacaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcggccaagggaccaaggtggaaatcaaacgactgtggctgcacca

SEQ ID NO: 545502 - DNA, 480 bp, Homo sapiens
  misc_feature: HIJSMM301CG0EW.48.38.D05.1.454.light.4.raw
agtatacatacacgaccggtgctcgatttagtatctgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 545503 - DNA, 489 bp, Homo sapiens
  misc_feature: HIJSMM301EFUX1.51.28.C06.1.454.light.4.raw
cgatcgtatacacgaccggtgctcgatttagagctcacgtattgggtttggggtggaagaacctgcccagcctgggcctcatgaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcacg

SEQ ID NO: 545504 - DNA, 485 bp, Homo sapiens; identical to SEQ ID NO: 536075
  misc_feature: HIJSMM301D5EEN.17.21.B10.1.454.light.4.raw

SEQ ID NO: 545505 - DNA, 494 bp, Homo sapiens; identical to SEQ ID NO: 534994
  misc_feature: HIJSMM301B8RH9.27.78.H01.1.454.light.4.raw

SEQ ID NO: 545506 - DNA, 497 bp, Homo sapiens
  misc_feature: HIJSMM301EESD4.19.71.G05.1.454.light.4.raw
tactctcgtgcacgaccggtgctcgatttagtgtcgtcgcaagagagaggggggtacgaacaggcaggcaggggcgagcaagaatggtgttgcagacccacggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 545507 - DNA, 495 bp, Homo sapiens
  misc_feature: HIJSMM301EH1UM.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactggaaattaaacgaactgtggctgcaccatctgtcttcatcttcccgcc

SEQ ID NO: 545508 - DNA, 504 bp, Homo sapiens; identical to SEQ ID NO: 535561
  misc_feature: HIJSMM301AM2SW.4.57.F02.1.454.light.4.raw

SEQ ID NO: 545509 - DNA, 505 bp, Homo sapiens
  misc_feature: HIJSMM301EOHJG.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcgcggagggaccaaggtggagatcaaacgaactgtggctgcaccatctgtt

SEQ ID NO: 545510 - DNA, 494 bp, Homo sapiens; identical to SEQ ID NO: 534992
  misc_feature: HIJSMM301EMUK7.9.1.A01.1.454.light.4.raw

SEQ ID NO: 545511 - DNA, 486 bp, Homo sapiens; identical to SEQ ID NO: 535458
  misc_feature: HIJSMM301EVZW1.7.75.G09.1.454.light.4.raw

SEQ ID NO: 545512 - DNA, 515 bp, Homo sapiens
  misc_feature: HIJSMM301AGT0Y.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacggaccgaacggtaggaaagtacaagacgaacgtagtggcgtgcaccactctgtcttctatcttcccgt

SEQ ID NO: 545513 - DNA, 475 bp, Homo sapiens
  misc_feature: HIJSMM301D45B0.8.67.G01.1.454.light.4.raw
ctcgcgtgtccacgaccggtgctcgatttagagtatacatattgggtttggggctttccttggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctgggggcagattttcacccctcacccatcagcagtctgcaacctgaagactttgcaacttactactgtcagcagtcttacagtaggccgggcacctttggccaggggacgaagctggagatcgaacgaactgtggctgcaccatctgtcttcatcttctcgccatctgagacacgcgag

SEQ ID NO: 545514 - DNA, 489 bp, Homo sapiens; identical to SEQ ID NO: 535139
  misc_feature: HIJSMM301DO2HA.14.55.E11.1.454.light.4.raw

SEQ ID NO: 545515 - DNA, 445 bp, Homo sapiens; identical to SEQ ID NO: 536070
  misc_feature: HIJSMM301AD7RP.5.9.A09.1.454.light.4.raw

SEQ ID NO: 545516 - DNA, 484 bp, Homo sapiens; identical to SEQ ID NO: 535240
  misc_feature: HIJSMM301DG2QK.47.60.F05.1.454.light.4.raw

SEQ ID NO: 545517 - DNA, 488 bp, Homo sapiens
  misc_feature: HIJSMM301ARFAS.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccacggacgacgactgagattaaacgaactgtggctgcaccatctgtcttcat

SEQ ID NO: 545518 - DNA, 483 bp, Homo sapiens
  misc_feature: HIJSMM301EVVED.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccgaaggtggagatcaaacgaactagtggctgcacca

SEQ ID NO: 545519 - DNA, 494 bp, Homo sapiens; identical to SEQ ID NO: 535828
  misc_feature: HIJSMM301BIX1H.3.36.D03.1.454.light.4.raw

SEQ ID NO: 545520 - DNA, 492 bp, Homo sapiens; identical to SEQ ID NO: 539732
  misc_feature: HIJSMM301DFOLS.4.9.A09.1.454.light.4.raw

SEQ ID NO: 545521 - DNA, 495 bp, Homo sapiens
  misc_feature: HIJSMM301BVFZL.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggacttttattactgtcagcagcgtgagttctggcctccgctcactttcggcggagggaccgagggtggaggactacaaacgaactgtggctgcaccactctgtctt

SEQ ID NO: 545522 - DNA, 484 bp, Homo sapiens
  misc_feature: HIJSMM301A8N92.51.60.F05.1.454.light.4.raw
cgatcgtatacacgaccggtgctcgatttagtacgtcatcagggaaaggggtgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgcccccc

SEQ ID NO: 545523 - DNA, 504 bp, Homo sapiens; identical to SEQ ID NO: 538940
  misc_feature: HIJSMM301DGPQ8.2.35.D02.1.454.light.4.raw

SEQ ID NO: 545524 - DNA, 485 bp, Homo sapiens
  misc_feature: HIJSMM301EHW4Z.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgccctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcggagtggaggctgaggatgttgggctctattattgcatgcaagctctacaagtcccgctcacttcggcggagggaccaaggtggagatcaaacgaact

SEQ ID NO: 545525 - DNA, 477 bp, Homo sapiens; identical to SEQ ID NO: 535122
  misc_feature: HIJSMM301BH3VJ.26.72.G06.1.454.light.4.raw

SEQ ID NO: 545526 - DNA, 496 bp, Homo sapiens
  misc_feature: HIJSMM301B2QM6.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcagggtccctgaccggttctctggctccaagtctggctcttccgcctccttggccatcactgggctcgaggctgacgatgaggctgattactactgtctgtcctatgacgacgacctacagactccggttttcggcggagggctaagctgaccgtcctaagtcagcccaa

SEQ ID NO: 545527 - DNA, 521 bp, Homo sapiens
  misc_feature: HIJSMM301B5F64.12.71.G05.1.454.light.4.raw
  modified_base (494)..(494): a, c, t, g, unknown or other
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcggggaccaaagtgaccgtcctaagtcagcccaaggctnccccctcggtcactctgttcccaccct

SEQ ID NO: 545528 - DNA, 506 bp, Homo sapiens
  misc_feature: HIJSMM301BLC0M.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaataagaggtcaacgaactagtggctgcaccatctgtcttcatt

SEQ ID NO: 545529 - DNA, 501 bp, Homo sapiens
  misc_feature: HIJSMM301BQ48J.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaaggctgaccgtcctaggtcagcccaaggctgccccctggtcta

SEQ ID NO: 545530 - DNA, 488 bp, Homo sapiens
  misc_feature: HIJSMM301DFYVV.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggggaccaagctggagatcaaacgaa

SEQ ID NO: 545531 - DNA, 475 bp, Homo sapiens; identical to SEQ ID NO: 537714
  misc_feature: HIJSMM301AMOSK.7.81.H04.1.454.light.4.raw

SEQ ID NO: 545532 - DNA, 485 bp, Homo sapiens; identical to SEQ ID NO: 538194
  misc_feature: HIJSMM301ANZ9Y.47.62.F07.1.454.light.4.raw

SEQ ID NO: 545533 - DNA, 487 bp, Homo sapiens
  misc_feature: HIJSMM301AT92A.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaaatacttaatctttatgtcttcggatctgggaccagggtcaccgtcctaggtcagcccaaggccaa

SEQ ID NO: 545534 - DNA, 494 bp, Homo sapiens; identical to SEQ ID NO: 534992
  misc_feature: HIJSMM301EHM9M.9.1.A01.1.454.light.4.raw

SEQ ID NO: 545535 - DNA, 480 bp, Homo sapiens
  misc_feature: HIJSMM301APGL8.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaggtggagatcaacgaactgtggctgcacc

SEQ ID NO: 545536 - DNA, 481 bp, Homo sapiens; identical to SEQ ID NO: 537385
  misc_feature: HIJSMM301CML9K.52.4.A04.1.454.light.4.raw

SEQ ID NO: 545537 - DNA, 484 bp, Homo sapiens; identical to SEQ ID NO: 535211
  misc_feature: HIJSMM301A2VF2.47.46.E02.1.454.light.4.raw

SEQ ID NO: 545538 - DNA, 502 bp, Homo sapiens; identical to SEQ ID NO: 541971
  misc_feature: HIJSMM301AVHRQ.4.39.D06.1.454.light.4.raw

SEQ ID NO: 545539 - DNA, 485 bp, Homo sapiens; identical to SEQ ID NO: 539691
  misc_feature: HIJSMM301A1DJF.15.1.A01.1.454.light.4.raw
  modified_base (467)..(467): a, c, t, g, unknown or other

SEQ ID NO: 545540 - DNA, 469 bp, Homo sapiens
  misc_feature: HIJSMM301ET1BR.3.20.B09.1.454.light.4.raw
agacgcactccacgaccggtgctcgatttagtgtagtgtgaagggggcaggagtcagtctcagtcaggacacagcatggacatgagggtccccgctcagctcctgggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaaggtggagatcaaacgaaa

SEQ ID NO: 545541 - DNA, 494 bp, Homo sapiens; identical to SEQ ID NO: 534994
  misc_feature: HIJSMM301A61F1.27.78.H01.1.454.light.4.raw

SEQ ID NO: 545542 - DNA, 487 bp, Homo sapiens
  misc_feature: HIJSMM301CCJWG.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtggataatcagacgaa

SEQ ID NO: 545543 - DNA, 513 bp, Homo sapiens; identical to SEQ ID NO: 535244
  misc_feature: HIJSMM301EGF1N.17.33.C11.1.454.light.4.raw

SEQ ID NO: 545544 - DNA, 449 bp, Homo sapiens
  misc_feature: HIJSMM301CWG6R.18.9.A09.1.454.light.4.raw
  modified_base (431)..(431): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactacctcatctttggtagcaacaatcggccctcaggggtcccgtgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccnccctcctccatactcgta

SEQ ID NO: 545545 - DNA, 494 bp, Homo sapiens
  misc_feature: HIJSMM301AE9YN.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggtccgagggaccgaaggtaggaaggtcaagcgaactagtggcgtgcaccatctgt

SEQ ID NO: 545546 - DNA, 490 bp, Homo sapiens
  misc_feature: HIJSMM301D95V6.46.26.C04.1.454.light.4.raw
actagcagtacacgaccggtgctcgatttagtctagcgactttgggtttggggtgatcaggactcctcagttcaccttctcacaatgaggctccctgctcagctcctggggctactaatgctctgggtctctggatccagtggggatattgtgatgactcagtctccactctccctgcccgtcacccctggagagccggcctccatctcctgcaggtctagtcggagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgtgg

SEQ ID NO: 545547 - DNA, 496 bp, Homo sapiens; identical to SEQ ID NO: 537925
  misc_feature: HIJSMM301DGS39.22.14.B03.1.454.light.4.raw

SEQ ID NO: 545548 - DNA, 455 bp, Homo sapiens
  misc_feature: HIJSMM301D2KB8.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaaccctcctccacgagagta

SEQ ID NO: 545549 - DNA, 488 bp, Homo sapiens
  misc_feature: HIJSMM301BG84S.19.21.B10.1.454.light.4.raw
  modified_base (409)..(409): a, c, t, g, unknown or other
tactctcgtgcacgaccggtgctcgatttagtgtcgtcgcaagagaggaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgctaggctgaagntgtggcagtttattattgtcaacaatattattatacttcgtggacgttcggccaaggaccaaggtggatatcagacgaa

SEQ ID NO: 545550 - DNA, 490 bp, Homo sapiens
  misc_feature: HIJSMM301BZN3F.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaggaccaaggtggaagtcaacgaactagtggctgcaccactctgtctt

SEQ ID NO: 545551 - DNA, 484 bp, Homo sapiens
  misc_feature: HIJSMM301BUHQ3.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaacttatttaaattggtatcagctgaaacccgggaaagcccctaagctcctgatcctcgatgcattcactttggaaacaggggtcccatcaaggttcagtgggagtggctctgggacaggattttactttcaccatcagcagcctgcagcctgaggatattgcaacatattactgtcaacagtacgataatctcccgctcactttcggcgggggaccgaaggtggagatcaaacgaactgtggctgcacc

SEQ ID NO: 545552 - DNA, 492 bp, Homo sapiens
  misc_feature: HIJSMM301BFCLC.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaaagtattccttttactttcggccctgggaccaaagtggatatcaaacgaactgtggctgcaccat

SEQ ID NO: 545553 - DNA, 488 bp, Homo sapiens; identical to SEQ ID NO: 535081
  misc_feature: HIJSMM301D1LMZ.26.23.C01.1.454.light.4.raw

SEQ ID NO: 545554 - DNA, 447 bp, Homo sapiens; identical to SEQ ID NO: 535201
  misc_feature: HIJSMM301C310I.18.9.A09.1.454.light.4.raw

SEQ ID NO: 545555 - DNA, 508 bp, Homo sapiens
  misc_feature: HIJSMM301ERFN2.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 545556 - DNA, 446 bp, Homo sapiens
  misc_feature: HIJSMM301BRDFG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggaactgggaccaaggtcaccgtcctaggtcagcccaaggccaacccactgtcactctgttcccaccctcctccatactcgta

SEQ ID NO: 545557 - DNA, 494 bp, Homo sapiens; identical to SEQ ID NO: 535276
  misc_feature: HIJSMM301ARWIF.16.6.A06.1.454.light.4.raw

SEQ ID NO: 545558 - DNA, 495 bp, Homo sapiens
  misc_feature: HIJSMM301B2WL8.12.88.H11.1.454.light.4.raw
atacgacgtacacgaccggtgctcgatttagcgacagcgagaacacacaaagggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcaggcgggtcagggacagatttcacactagaaaatcaggccgggtgggggcgtggaggatgttggctatttattactgcatgcaggctatacaccttcctgcctacttttggccgagggaccgaagctggagatcaggcgaacg

SEQ ID NO: 545559 - DNA, 487 bp, Homo sapiens; identical to SEQ ID NO: 535358
  misc_feature: HIJSMM301CT737.47.70.G04.1.454.light.4.raw

SEQ ID NO: 545560 - DNA, 505 bp, Homo sapiens
  misc_feature: HIJSMM301APGWI.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccgacggggaccgaacgacgtcggaggatcaaacgaaactagtggctgcaccatctgtctt

SEQ ID NO: 545561 - DNA, 480 bp, Homo sapiens; identical to SEQ ID NO: 535975
  misc_feature: HIJSMM301BWXK2.51.60.F05.1.454.light.4.raw

SEQ ID NO: 545562 - DNA, 494 bp, Homo sapiens
  misc_feature: HIJSMM301EIAE3.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtgctgcaccatctgtcttcatcttccccg

SEQ ID NO: 545563 - DNA, 505 bp, Homo sapiens; identical to SEQ ID NO: 535503
  misc_feature: HIJSMM301B900S.8.28.C06.1.454.light.4.raw

SEQ ID NO: 545564 - DNA, 483 bp, Homo sapiens
  misc_feature: HIJSMM301DSZZB.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctcgctcactttcgcggagggaccaaggtggagatcaaacgaactgtggctgcacc

SEQ ID NO: 545565 - DNA, 487 bp, Homo sapiens; identical to SEQ ID NO: 538190
  misc_feature: HIJSMM301CMWPU.47.70.G04.1.454.light.4.raw

SEQ ID NO: 545566 - DNA, 496 bp, Homo sapiens
  misc_feature: HIJSMM301CSU4Y.26.78.H01.1.454.light.4.raw
agactatactcacgaccggtgctcgatttagtgtgagtagtttgggtttgggggaggaactgctcaagttacggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggaggagtcagacgaacgtgtggctgcaccatctgtt

SEQ ID NO: 545567 - DNA, 488 bp, Homo sapiens
  misc_feature: HIJSMM301AMQ39.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggtccaggggaccaagctggagatcaaacgaa

SEQ ID NO: 545568 - DNA, 472 bp, Homo sapiens
  misc_feature: HIJSMM301CAG8S.15.81.H04.1.454.light.4.raw
tctacgtagccacgaccggtgctcgatttagtagtgtagattcgcggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgctacgtaga

SEQ ID NO: 545569 - DNA, 497 bp, Homo sapiens
  misc_feature: HIJSMM301BF1C9.43.34.D01.1.454.light.4.raw
tgtgagtagtcacgaccggtgctcgatttagatcgtctgtgttgagtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccactgtcactctttcccgccctcctcactactcaca

SEQ ID NO: 545570 - DNA, 497 bp, Homo sapiens; identical to SEQ ID NO: 534982
  misc_feature: HIJSMM301AOAZJ.26.80.H03.1.454.light.4.raw

SEQ ID NO: 545571 - DNA, 488 bp, Homo sapiens; identical to SEQ ID NO: 542699
  misc_feature: HIJSMM301APXYR.12.51.E07.1.454.light.4.raw

SEQ ID NO: 545572 - DNA, 463 bp, Homo sapiens; identical to SEQ ID NO: 535062
  misc_feature: HIJSMM301C4I5V.11.73.G07.1.454.light.4.raw

SEQ ID NO: 545573 - DNA, 473 bp, Homo sapiens
  misc_feature: HIJSMM301C99L9.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcgactttcaccatcagcagcctgcaacctgaagatattgcaacatattactgtcaacagtatgatagtctggccgccttcggcggagggaccaaggtggagatcgaacgaactgtgg

SEQ ID NO: 545574 - DNA, 512 bp, Homo sapiens
  misc_feature: HIJSMM301CDPH6.16.66.F11.1.454.light.4.raw
  modified_base (414)..(414): a, c, t, g, unknown or other
  modified_base (494)..(494): a, c, t, g, unknown or other
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgccccaccagagtgatctatgaggataacctacggccctctggggtccctcctcggtttctggctccatcgacgggtcctccactactgcctccctcaccatctctggactgaagactgaggacgaggctgactactactgtcagtcttatgataacnccagggtggtgttcggcggagggaccaagctggccgtcctaggtcagcccaaggctgccccctcggtcactctgttcccnccctcctcgagtagtaca

SEQ ID NO: 545575 - DNA, 493 bp, Homo sapiens
  misc_feature: HIJSMM301AFHS7.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagatttttactttcaccatcagcagcctgcagcctgaagatattgcaacatattactgtcaacagtatcataatctccccacctttcggtccctcgggaccgaaacgtaggatatcaaacgaactagtggctgcaccatctgt

SEQ ID NO: 545576 - DNA, 501 bp, Homo sapiens; identical to SEQ ID NO: 536142
  misc_feature: HIJSMM301B0E89.15.1.A01.1.454.light.4.raw

SEQ ID NO: 545577 - DNA, 480 bp, Homo sapiens; identical to SEQ ID NO: 545225
  misc_feature: HIJSMM301EB5FZ.43.12.B01.1.454.light.4.raw

SEQ ID NO: 545578 - DNA, 497 bp, Homo sapiens; identical to SEQ ID NO: 538296
  misc_feature: HIJSMM301ARJHP.18.11.A11.1.454.light.4.raw

SEQ ID NO: 545579 - DNA, 508 bp, Homo sapiens
  misc_feature: HIJSMM301A2VIK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaagtacaaacgaactagtggctgcaccactctgtcttctatcttccccg

SEQ ID NO: 545580 - DNA, 499 bp, Homo sapiens
  misc_feature: HIJSMM301ARIFA.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccaaggtggaaatcaacgaactgtggctgcaccatc

SEQ ID NO: 545581 - DNA, 481 bp, Homo sapiens
  misc_feature: HIJSMM301AVYS0.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcacg

SEQ ID NO: 545582 - DNA, 492 bp, Homo sapiens
  misc_feature: HIJSMM301BXXMM.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcgaggagggaccagggtggagatcaaacgaactgtggctgcaccatctgtcttcta

SEQ ID NO: 545583 - DNA, 481 bp, Homo sapiens; identical to SEQ ID NO: 535993
  misc_feature: HIJSMM301BD4H4.21.25.C03.1.454.light.4.raw

SEQ ID NO: 545584 - DNA, 477 bp, Homo sapiens; identical to SEQ ID NO: 537931
  misc_feature: HIJSMM301CGOXA.48.5.A05.1.454.light.4.raw

SEQ ID NO: 545585 - DNA, 518 bp, Homo sapiens
  misc_feature: HIJSMM301C3SN7.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactactca

SEQ ID NO: 545586 - DNA, 489 bp, Homo sapiens
  misc_feature: HIJSMM301BDI9E.5.49.E05.1.454.light.4.raw
atcagacacgcacgaccggtgctcgatttagagcgactagcaacacacaaagggggctgctcagttaggacccagagggaaccatggaaaccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 545587 - DNA, 512 bp, Homo sapiens
  misc_feature: HIJSMM301EMR5R.17.33.C11.1.454.light.4.raw
cgtagactagcacgaccggtgctcgatttagagtgagctcgttgggtttgggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtctaagtcagcccaaggctgccccctcggtcactctgttccccgccctcct

SEQ ID NO: 545588 - DNA, 501 bp, Homo sapiens; identical to SEQ ID NO: 536867
  misc_feature: HIJSMM301CFLFD.5.86.H09.1.454.light.4.raw

SEQ ID NO: 545589 - DNA, 485 bp, Homo sapiens
  misc_feature: HIJSMM301DQO1O.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaaacgaactgtggctgcacca

SEQ ID NO: 545590 - DNA, 510 bp, Homo sapiens
  misc_feature: HIJSMM301BXS58.7.34.D01.1.454.light.4.raw
cgtgtctctacacgaccggtgctcgatttagatcgtctgtgttgggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 545591 - DNA, 471 bp, Homo sapiens
  misc_feature: HIJSMM301C6CUZ.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcag

SEQ ID NO: 545592 - DNA, 454 bp, Homo sapiens; identical to SEQ ID NO: 535005
  misc_feature: HIJSMM301ALAVM.19.86.H09.1.454.light.4.raw

SEQ ID NO: 545593 - DNA, 491 bp, Homo sapiens
  misc_feature: HIJSMM301CXDYL.3.72.G06.1.454.light.4.raw
agacgcactccacgaccggtgctcgatttagctacgactgcaagggaaagggggaggaactgctcagttgggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggaccaaggtggagatcaaacgaactgtggctgcaccatctgtt

SEQ ID NO: 545594 - DNA, 494 bp, Homo sapiens; identical to SEQ ID NO: 534994
  misc_feature: HIJSMM301AE15H.27.78.H01.1.454.light.4.raw

SEQ ID NO: 545595 - DNA, 515 bp, Homo sapiens; identical to SEQ ID NO: 538805
  misc_feature: HIJSMM301AMUXU.14.19.B08.1.454.light.4.raw

SEQ ID NO: 545596 - DNA, 508 bp, Homo sapiens; identical to SEQ ID NO: 535835
  misc_feature: HIJSMM301BJLFH.8.34.D01.1.454.light.4.raw

SEQ ID NO: 545597 - DNA, 463 bp, Homo sapiens; identical to SEQ ID NO: 535062
  misc_feature: HIJSMM301DFV8O.11.73.G07.1.454.light.4.raw

SEQ ID NO: 545598 - DNA, 500 bp, Homo sapiens
  misc_feature: HIJSMM301EF8YV.15.57.F02.1.454.light.4.raw
tctacgtagccacgaccggtgctcgatttagctcgatatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccacctcctcgctacgtaga

SEQ ID NO: 545599 - DNA, 468 bp, Homo sapiens
  misc_feature: HIJSMM301C4MU1.3.38.D05.1.454.light.4.raw
  modified_base (458)..(458): a, c, t, g, unknown or other
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcacttcgcgggggaccgaagtggngatcaacgaa

SEQ ID NO: 545600 - DNA, 501 bp, Homo sapiens; identical to SEQ ID NO: 535746
  misc_feature: HIJSMM301CBSMA.18.11.A11.1.454.light.4.raw

SEQ ID NO: 545601 - DNA, 521 bp, Homo sapiens
  misc_feature: HIJSMM301AZU4U.40.46.E02.1.454.light.4.raw
tctagcgactcacgaccggtgctcgatttagactcatctacagggaaaggggagtctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgct

SEQ ID NO: 545602 - DNA, 502 bp, Homo sapiens
  misc_feature: HIJSMM301BCQ0O.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtcccgtcgaccgacttcagtggcagcgggtcgtgggacgagatttctactctcaccatcagcagcctgcaggctgaagatgtggcagtttattattgtcaacaatattattatacttcgtggacgtcggtccaaggaccgaagtaggagtatacagacgaacgtagtgg

SEQ ID NO: 545603 - DNA, 496 bp, Homo sapiens; identical to SEQ ID NO: 535541
  misc_feature: HIJSMM301BITF5.3.33.C11.1.454.light.4.raw

SEQ ID NO: 545604 - DNA, 444 bp, Homo sapiens; identical to SEQ ID NO: 535027
  misc_feature: HIJSMM301EPDHQ.8.73.G07.1.454.light.4.raw

SEQ ID NO: 545605 - DNA, 514 bp, Homo sapiens
  misc_feature: HIJSMM301A1PL5.18.78.H01.1.454.light.4.raw
  modified_base (450)..(450): a, c, t, g, unknown or other
  modified_base (489)..(489): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcacacgcacactctaatnttcgtacgacgtcggacgacgtaccaccgtacgtgtacnccgaccgacgacccaacccatcgta

SEQ ID NO: 545606 - DNA, 441 bp, Homo sapiens; identical to SEQ ID NO: 534971
  misc_feature: HIJSMM301CLUI0.11.3.A03.1.454.light.4.raw

SEQ ID NO: 545607 - DNA, 503 bp, Homo sapiens
  misc_feature: HIJSMM301EF5QP.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttccgcc

SEQ ID NO: 545608 - DNA, 517 bp, Homo sapiens; identical to SEQ ID NO: 535261
  misc_feature: HIJSMM301BYPTN.19.80.H03.1.454.light.4.raw

SEQ ID NO: 545609 - DNA, 507 bp, Homo sapiens
  misc_feature: HIJSMM301BG3R9.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcgggggaccaagctgaccgtcctaggtcagcccaaggctcgccccccg

SEQ ID NO: 545610 - DNA, 506 bp, Homo sapiens
  misc_feature: HIJSMM301CU920.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcact

SEQ ID NO: 545611 - DNA, 503 bp, Homo sapiens
  misc_feature: HIJSMM301CAKOV.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtagggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatt

SEQ ID NO: 545612 - DNA, 447 bp, Homo sapiens; identical to SEQ ID NO: 535201
  misc_feature: HIJSMM301CV3JN.18.9.A09.1.454.light.4.raw

SEQ ID NO: 545613 - DNA, 502 bp, Homo sapiens
  misc_feature: HIJSMM301BG5HU.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttggtgttcggcggagggaccaagctgaccgtcctaggtcagcccaaggctgccccctcggtcac

SEQ ID NO: 545614 - DNA, 521 bp, Homo sapiens; identical to SEQ ID NO: 538715
  misc_feature: HIJSMM301CK92O.27.23.C01.1.454.light.4.raw

SEQ ID NO: 545615 - DNA, 454 bp, Homo sapiens; identical to SEQ ID NO: 536347
  misc_feature: HIJSMM301BCBOM.19.86.H09.1.454.light.4.raw

SEQ ID NO: 545616 - DNA, 466 bp, Homo sapiens
  misc_feature: HIJSMM301ARDAD.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccaaagtggatgtcaaccgaa

SEQ ID NO: 545617 - DNA, 484 bp, Homo sapiens
  misc_feature: HIJSMM301D36VH.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaagggaccaaggtaggaatcaaacgaactgtggctgcaccta

SEQ ID NO: 545618 - DNA, 447 bp, Homo sapiens; identical to SEQ ID NO: 535201
  misc_feature: HIJSMM301EJTIO.18.9.A09.1.454.light.4.raw

SEQ ID NO: 545619 - DNA, 502 bp, Homo sapiens; identical to SEQ ID NO: 535463
  misc_feature: HIJSMM301CNVIS.43.86.H09.1.454.light.4.raw

SEQ ID NO: 545620 - DNA, 493 bp, Homo sapiens; identical to SEQ ID NO: 539456
  misc_feature: HIJSMM301BQZRR.10.79.H02.1.454.light.4.raw

SEQ ID NO: 545621 - DNA, 497 bp, Homo sapiens
  misc_feature: HIJSMM301A0O7Q.51.59.F04.1.454.light.4.raw
  modified_base (447)..(447): a, c, t, g, unknown or other
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctcgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactncgaccaaggtcaccgtcctgggtcagcccaacggcaaccccactgtcact

SEQ ID NO: 545622 - DNA, 486 bp, Homo sapiens; identical to SEQ ID NO: 537428
  misc_feature: HIJSMM301DJCI4.47.62.F07.1.454.light.4.raw

SEQ ID NO: 545623 - DNA, 484 bp, Homo sapiens
  misc_feature: HIJSMM301EYSMK.49.26.C04.1.454.light.4.raw
agtcgagagacacgaccggtgctcgatttagtctagcgactttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgatatgtggcagtgtattactgtcagcaatatcacactgctccgctcactttcggcggagggaccagggtgagatcaaacgaa

SEQ ID NO: 545624 - DNA, 494 bp, Homo sapiens
  misc_feature: HIJSMM301COSX6.52.87.H10.1.454.light.4.raw
cgcagtacgacacgaccggtgctcgatttagcagtactgcgttgggtttgggggtgggtccaggaggcagaactctgggtgtctcaccatggcctggatccctctacttctccccctcctcactctctgcacaggctctctgcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 545625 - DNA, 486 bp, Homo sapiens; identical to SEQ ID NO: 535043
  misc_feature: HIJSMM301AHGKU.46.35.D02.1.454.light.4.raw

SEQ ID NO: 545626 - DNA, 515 bp, Homo sapiens
  misc_feature: HIJSMM301B81GE.16.46.E02.1.454.light.4.raw
tgtactactccacgaccggtgctcgatttagactcatctacaggggaaagggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactcttccg

SEQ ID NO: 545627 - DNA, 511 bp, Homo sapiens
  misc_feature: HIJSMM301CBN3W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaacgggaccgaaggtggaaagtcaaacgaactagtggcgtgcaccatctgtcttctatcttccccg

SEQ ID NO: 545628 - DNA, 488 bp, Homo sapiens
  misc_feature: HIJSMM301CZ4GG.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcgagatcagacgaactgtggctgcaccatctgtcttcta

SEQ ID NO: 545629 - DNA, 495 bp, Homo sapiens
  misc_feature: HIJSMM301CF4OY.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagagttaaaggaactgtggctgcaccatctgtcttcatcttccccg

SEQ ID NO: 545630 - DNA, 486 bp, Homo sapiens; identical to SEQ ID NO: 535290
  misc_feature: HIJSMM301BZISC.3.12.B01.1.454.light.4.raw

SEQ ID NO: 545631 - DNA, 515 bp, Homo sapiens
  misc_feature: HIJSMM301BHMTE.17.33.C11.1.454.light.4.raw
  modified_base (474)..(474): a, c, t, g, unknown or other
cgtagactagcacgaccggtgctcgatttagagtgagctcgttgggtttgggggcgccagggtcccgttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaaaaacacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgacctcttaagtcancccaaggctgcccccctcggtcactctgttcccaccctcct

SEQ ID NO: 545632 - DNA, 492 bp, Homo sapiens
  misc_feature: HIJSMM301EMUWW.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattggcggagggaccaaggtgaccgtcctacgtcagcccaaggctgccccctcggtcact

SEQ ID NO: 545633 - DNA, 454 bp, Homo sapiens; identical to SEQ ID NO: 536347
  misc_feature: HIJSMM301BODFK.19.86.H09.1.454.light.4.raw

SEQ ID NO: 545634 - DNA, 508 bp, Homo sapiens; identical to SEQ ID NO: 536388
  misc_feature: HIJSMM301EO40C.11.57.F02.1.454.light.4.raw

SEQ ID NO: 545635 - DNA, 491 bp, Homo sapiens
  misc_feature: HIJSMM301BCX29.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcacttattctgtcaccagtatggtaggtcaccgtacacttttggccaggggaccaagctggagatcaagcgaactgtggctgcaccatctgtcttcta

SEQ ID NO: 545636 - DNA, 485 bp, Homo sapiens; identical to SEQ ID NO: 538956
  misc_feature: HIJSMM301BCCNA.40.69.G03.1.454.light.4.raw

SEQ ID NO: 545637 - DNA, 492 bp, Homo sapiens
  misc_feature: HIJSMM301C4817.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatt

SEQ ID NO: 545638 - DNA, 495 bp, Homo sapiens
  misc_feature: HIJSMM301BOSHK.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggatcagtctgaccgtcctaggtcagcccaaggctgcccctcggtcactc

SEQ ID NO: 545639 - DNA, 494 bp, Homo sapiens
  misc_feature: HIJSMM301BIXQO.41.53.E09.1.454.light.4.raw
tctatactatcacgaccggtgctcgatttagagagagtgtgttggttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcgggcggagggaccaagctgaccgtcctaggtcagcccaa

SEQ ID NO: 545640 - DNA, 473 bp, Homo sapiens; identical to SEQ ID NO: 536937
  misc_feature: HIJSMM301D6V6E.13.76.G10.1.454.light.4.raw

SEQ ID NO: 545641 - DNA, 485 bp, Homo sapiens; identical to SEQ ID NO: 535606
  misc_feature: HIJSMM301DPJXB.47.46.E02.1.454.light.4.raw

SEQ ID NO: 545642 - DNA, 493 bp, Homo sapiens
  misc_feature: HIJSMM301D56YY.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctcgatcgattctctggctccaagtctggcaacacggcctccctcgaacatctctgggctccaggctgaggatgaggctgattattattgctgctcatatggagtacctactctttctctcggaactggaccacgtcaccgtcctaggtcagcccaaggccaacccca

SEQ ID NO: 545643 - DNA, 484 bp, Homo sapiens; identical to SEQ ID NO: 535400
  misc_feature: HIJSMM301BV2AC.46.26.C04.1.454.light.4.raw

SEQ ID NO: 545644 - DNA, 480 bp, Homo sapiens; identical to SEQ ID NO: 535291
  misc_feature: HIJSMM301ATFTZ.22.59.F04.1.454.light.4.raw

SEQ ID NO: 545645 - DNA, 486 bp, Homo sapiens; identical to SEQ ID NO: 535385
  misc_feature: HIJSMM301CQK99.19.71.G05.1.454.light.4.raw

SEQ ID NO: 545646 - DNA, 483 bp, Homo sapiens; identical to SEQ ID NO: 544010
  misc_feature: HIJSMM301BHFD8.19.5.A05.1.454.light.4.raw

SEQ ID NO: 545647 - DNA, 491 bp, Homo sapiens
  misc_feature: HIJSMM301C82GY.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactacctctcactttcggaggaggaccagggtggagatcaaacgaactgtggctgcaccatctgtcttcta

SEQ ID NO: 545648 - DNA, 504 bp, Homo sapiens; identical to SEQ ID NO: 538940
  misc_feature: HIJSMM301COQJF.2.35.D02.1.454.light.4.raw

SEQ ID NO: 545649 - DNA, 510 bp, Homo sapiens
  misc_feature: HIJSMM301EKA0Y.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctccatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccgactttcggccctgggaccgaaacgtggagtatcaaacgaactgtggctgcaccatctgtctt

SEQ ID NO: 545650 - DNA, 510 bp, Homo sapiens
  misc_feature: HIJSMM301BL8WT.9.53.E09.1.454.light.4.raw
tgatacgtctcacgaccggtgctcgatttagagagagtgtgttggggtttggggggtcgacaagaggcagcgctctcgggacgtctccaccatggcctgggctctgctgctcctcaccctcctcactcaggacacagggtccgtgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtggaccgtccctaggtcagcccaagggctggcccccccg

SEQ ID NO: 545651 - DNA, 514 bp, Homo sapiens
  misc_feature: HIJSMM301CUBH6.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccaccttcggcccgtcgggaccgaacggtaggagatcaaacgaactgtggctgcaccatctgtcttcta

SEQ ID NO: 545652 - DNA, 510 bp, Homo sapiens
  misc_feature: HIJSMM301AGGOD.48.53.E09.1.454.light.4.raw
agtatacatacacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggtttctccgactttcggcggagggaccgaaggtggaggtcaaacgaactgtggctgcaccatctgtctt

SEQ ID NO: 545653 - DNA, 491 bp, Homo sapiens; identical to SEQ ID NO: 535194
  misc_feature: HIJSMM301CIMVU.26.78.H01.1.454.light.4.raw

SEQ ID NO: 545654 - DNA, 503 bp, Homo sapiens
  misc_feature: HIJSMM301B79ZR.5.24.C02.1.454.light.4.raw
atcagacacgcacgaccggtgctcgatttagtacagatcgttagggaaaggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctgcccccg

SEQ ID NO: 545655 - DNA, 490 bp, Homo sapiens; identical to SEQ ID NO: 538273
  misc_feature: HIJSMM301BF559.16.73.G07.1.454.light.4.raw

SEQ ID NO: 545656 - DNA, 503 bp, Homo sapiens
  misc_feature: HIJSMM301DI8Z4.49.29.C07.1.454.light.4.raw
agtcgagagacacgaccggtgctcgatttagagtgctacgaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccagtctcctcatctttgatgcatcccacagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttcccgccat

SEQ ID NO: 545657 - DNA, 494 bp, Homo sapiens
  misc_feature: HIJSMM301AIHTY.14.55.E11.1.454.light.4.raw
  modified_base (451)..(451): a, c, t, g, unknown or other
  modified_base (454)..(454): a, c, t, g, unknown or other
  modified_base (484)..(484): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgaacgacggngancagacgaacgtagtggcgtgtcgaccactntcgttcttct

SEQ ID NO: 545658 - DNA, 494 bp, Homo sapiens; identical to SEQ ID NO: 534994
  misc_feature: HIJSMM301CD6JK.27.78.H01.1.454.light.4.raw

SEQ ID NO: 545659 - DNA, 504 bp, Homo sapiens
  misc_feature: HIJSMM301DJXQE.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtctt

SEQ ID NO: 545660 - DNA, 521 bp, Homo sapiens
  misc_feature: HIJSMM301D991R.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgcccctcggtcactctgttcccaccct

SEQ ID NO: 545661 - DNA, 485 bp, Homo sapiens; identical to SEQ ID NO: 536040
  misc_feature: HIJSMM301DAN6H.15.1.A01.1.454.light.4.raw

SEQ ID NO: 545662 - DNA, 496 bp, Homo sapiens; identical to SEQ ID NO: 537925
  misc_feature: HIJSMM301CKYS6.22.14.B03.1.454.light.4.raw

SEQ ID NO: 545663 - DNA, 496 bp, Homo sapiens
  misc_feature: HIJSMM301BUOCC.27.78.H01.1.454.light.4.raw
agcgtcgtctcacgaccggtgctcgatttagtgtgagtagtttgggtttgggggatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 545664 - DNA, 505 bp, Homo sapiens; identical to SEQ ID NO: 535503
  misc_feature: HIJSMM301C95GA.8.28.C06.1.454.light.4.raw

SEQ ID NO: 545665 - DNA, 518 bp, Homo sapiens
  misc_feature: HIJSMM301DWEUV.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccgccctcctcgacacg

SEQ ID NO: 545666 - DNA, 475 bp, Homo sapiens
  misc_feature: HIJSMM301CP32C.5.12.B01.1.454.light.4.raw
atcagacacgcacgaccggtgctcgatttagtagtgtagattccgcgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgagggacgaggctgactattattgcagttcatatggtagtatgaagactcttgtgattttcggcggagggaccaagctgaccgt

SEQ ID NO: 545667 - DNA, 383 bp, Homo sapiens; identical to SEQ ID NO: 447524
  misc_feature: HIJSMM301A66IJ.41.26.C04.1.454.light.4.raw

SEQ ID NO: 545668 - DNA, 486 bp, Homo sapiens
  misc_feature: HIJSMM301AYVYG.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctccactcactttcggcggagggaccaaggtcgagatcaaacgaactgtggctgcaccatctgtctt

SEQ ID NO: 545669 - DNA, 483 bp, Homo sapiens
  misc_feature: HIJSMM301C1DH3.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccatctgtt

SEQ ID NO: 545670 - DNA, 421 bp, Homo sapiens
  misc_feature: HIJSMM301B9EN0.41.15.B04.1.454.light.4.raw
tctatactatcacgaccggtgctcgatttagacagtatatatacgcgggcacgaccggtgctcgatttagtctagcgactttgggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 545671 - DNA, 494 bp, Homo sapiens
  misc_feature: HIJSMM301B9A1R.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 545672 - DNA, 497 bp, Homo sapiens
  misc_feature: HIJSMM301CXLDA.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcct

SEQ ID NO: 545673 - DNA, 484 bp, Homo sapiens; identical to SEQ ID NO: 535400
  misc_feature: HIJSMM301AYTOJ.46.26.C04.1.454.light.4.raw

SEQ ID NO: 545674 - DNA, 488 bp, Homo sapiens; identical to SEQ ID NO: 537504
  misc_feature: HIJSMM301AZQ3J.17.57.F02.1.454.light.4.raw

SEQ ID NO: 545675 - DNA, 488 bp, Homo sapiens
  misc_feature: HIJSMM301D4KNA.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcggaactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggagatcaaacgaa

SEQ ID NO: 545676 - DNA, 486 bp, Homo sapiens; identical to SEQ ID NO: 535043
  misc_feature: HIJSMM301D0M0O.46.35.D02.1.454.light.4.raw

SEQ ID NO: 545677 - DNA, 484 bp, Homo sapiens; identical to SEQ ID NO: 535400
  misc_feature: HIJSMM301A14CU.46.26.C04.1.454.light.4.raw

SEQ ID NO: 545678 - DNA, 473 bp, Homo sapiens
  misc_feature: HIJSMM301CH4KH.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttattctgtctacaagattctaattaccctcggacgttcggccaggggaccaaacgtggatgtcacgaactgtggctgcacc

SEQ ID NO: 545679 - DNA, 464 bp, Homo sapiens
  misc_feature: HIJSMM301AIWZQ.21.76.G10.1.454.light.4.raw
tcgtcgctcgcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccgggcgggtcaggacattagacattatttagcctggtatcagcagaaaccaggtaaagttcccaagctcctgatctatgctgcatcctctttgcaatcaggggtcccatctcggttcagtggcagtggatctgggacagatttcactctcaccatcagcagcctgcagcctgaagatgttgcaacttattactgtcaaaaatatagcagtgcccctctcactttcggcgcagggaccaaggtggacatcaaacg

SEQ ID NO: 545680 - DNA, 520 bp, Homo sapiens; identical to SEQ ID NO: 539176
  misc_feature: HIJSMM301C4H0U.27.23.C01.1.454.light.4.raw

SEQ ID NO: 545681 - DNA, 507 bp, Homo sapiens; identical to SEQ ID NO: 538702
  misc_feature: HIJSMM301AM1XV.11.57.F02.1.454.light.4.raw

SEQ ID NO: 545682 - DNA, 487 bp, Homo sapiens; identical to SEQ ID NO: 537573
  misc_feature: HIJSMM301AS9EX.3.10.A10.1.454.light.4.raw

SEQ ID NO: 545683 - DNA, 486 bp, Homo sapiens
  misc_feature: HIJSMM301CCDWB.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccagggacacgactggagattaaacgaactgtggctgcaccatctgtt

SEQ ID NO: 545684 - DNA, 497 bp, Homo sapiens; identical to SEQ ID NO: 535286
  misc_feature: HIJSMM301DM5OR.18.59.F04.1.454.light.4.raw

SEQ ID NO: 545685 - DNA, 489 bp, Homo sapiens; identical to SEQ ID NO: 535139
  misc_feature: HIJSMM301CEGRL.14.55.E11.1.454.light.4.raw

SEQ ID NO: 545686 - DNA, 506 bp, Homo sapiens
  misc_feature: HIJSMM301AIRSI.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactgtggctgcaccatctgt

SEQ ID NO: 545687 - DNA, 491 bp, Homo sapiens
  misc_feature: HIJSMM301AW8SD.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttgggcagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaatcagcagggtggaggctgaggatgttattgggctctattattgcatgcaagcaacacactggccgtacacttttggccaggggaccaagctggagatcaatcgaactgtgg

SEQ ID NO: 545688 - DNA, 478 bp, Homo sapiens
  misc_feature: HIJSMM301BZTWY.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagactgcagcctgaagattttgcaacttactattgtcaacaggctaacagtttcccgctcaccttcggcgggggaccgaaggtggagatcaacgaactgtggctgcacc

SEQ ID NO: 545689 - DNA, 469 bp, Homo sapiens
  misc_feature: HIJSMM301BQ1DJ.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcag

SEQ ID NO: 545690 - DNA, 486 bp, Homo sapiens; identical to SEQ ID NO: 535043
  misc_feature: HIJSMM301AME1C.46.35.D02.1.454.light.4.raw

SEQ ID NO: 545691 - DNA, 501 bp, Homo sapiens
  misc_feature: HIJSMM301BL6ES.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggagggaccaagctggccgtcctaggtcagcccaaggctgccccccg

SEQ ID NO: 545692 - DNA, 487 bp, Homo sapiens
  misc_feature: HIJSMM301BEB7T.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggccctgggaccatagtggatatgaaacgaactgttggctgcacc

SEQ ID NO: 545693 - DNA, 473 bp, Homo sapiens
  misc_feature: HIJSMM301DDPYX.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtctaagtcagcccc

SEQ ID NO: 545694 - DNA, 493 bp, Homo sapiens; identical to SEQ ID NO: 544835
  misc_feature: HIJSMM301AQXPA.43.29.C07.1.454.light.4.raw

SEQ ID NO: 545695 - DNA, 488 bp, Homo sapiens
  misc_feature: HIJSMM301ERKJ8.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcgggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 545696 - DNA, 447 bp, Homo sapiens; identical to SEQ ID NO: 535020
  misc_feature: HIJSMM301BNZ13.18.9.A09.1.454.light.4.raw

SEQ ID NO: 545697 - DNA, 501 bp, Homo sapiens; identical to SEQ ID NO: 536142
  misc_feature: HIJSMM301CSZGH.15.1.A01.1.454.light.4.raw

SEQ ID NO: 545698 - DNA, 505 bp, Homo sapiens; identical to SEQ ID NO: 536117
  misc_feature: HIJSMM301DPQ43.8.71.G05.1.454.light.4.raw

SEQ ID NO: 545699 - DNA, 497 bp, Homo sapiens; identical to SEQ ID NO: 535664
  misc_feature: HIJSMM301DZFU8.22.14.B03.1.454.light.4.raw

SEQ ID NO: 545700 - DNA, 486 bp, Homo sapiens; identical to SEQ ID NO: 535043
  misc_feature: HIJSMM301BRLXS.46.35.D02.1.454.light.4.raw

SEQ ID NO: 545701 - DNA, 489 bp, Homo sapiens; identical to SEQ ID NO: 535139
  misc_feature: HIJSMM301B28SX.14.55.E11.1.454.light.4.raw

SEQ ID NO: 545702 - DNA, 493 bp, Homo sapiens
  misc_feature: HIJSMM301CA5YK.40.34.D01.1.454.light.4.raw
tctagcgactcacgaccggtgctcgatttagatcgtctgtgttgggtttggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaa

SEQ ID NO: 545703 - DNA, 484 bp, Homo sapiens; identical to SEQ ID NO: 535287
  misc_feature: HIJSMM301BDNJ0.13.56.F01.1.454.light.4.raw

SEQ ID NO: 545704 - DNA, 487 bp, Homo sapiens; identical to SEQ ID NO: 536536
  misc_feature: HIJSMM301EPCFU.26.45.E01.1.454.light.4.raw

SEQ ID NO: 545705 - DNA, 487 bp, Homo sapiens; identical to SEQ ID NO: 535508
  misc_feature: HIJSMM301EO1ZC.13.87.H10.1.454.light.4.raw

SEQ ID NO: 545706 - DNA, 486 bp, Homo sapiens; identical to SEQ ID NO: 535917
  misc_feature: HIJSMM301CFQGQ.3.10.A10.1.454.light.4.raw

SEQ ID NO: 545707 - DNA, 488 bp, Homo sapiens; identical to SEQ ID NO: 535990
  misc_feature: HIJSMM301B05HI.11.28.C06.1.454.light.4.raw

SEQ ID NO: 545708 - DNA, 492 bp, Homo sapiens; identical to SEQ ID NO: 536010
  misc_feature: HIJSMM301A4UGI.10.20.B09.1.454.light.4.raw

SEQ ID NO: 545709 - DNA, 478 bp, Homo sapiens; identical to SEQ ID NO: 535129
  misc_feature: HIJSMM301BVZ6Q.11.11.A11.1.454.light.4.raw

SEQ ID NO: 545710 - DNA, 485 bp, Homo sapiens; identical to SEQ ID NO: 539951
  misc_feature: HIJSMM301CN96M.4.26.C04.1.454.light.4.raw

SEQ ID NO: 545711 - DNA, 484 bp, Homo sapiens; identical to SEQ ID NO: 544689
  misc_feature: HIJSMM301AMO5L.22.6.A06.1.454.light.4.raw

SEQ ID NO: 545712 - DNA, 503 bp, Homo sapiens
  misc_feature: HIJSMM301BS33H.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgactctacctcgtccgaacggacgacacgtagaggaattaaacgtaaaccagttggcgtcgcaccactctcgtcttctat

SEQ ID NO: 545713 - DNA, 443 bp, Homo sapiens
  misc_feature: HIJSMM301BXK2F.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctctctgtcgagcgt

SEQ ID NO: 545714 - DNA, 488 bp, Homo sapiens
  misc_feature: HIJSMM301BIWN4.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcacttttcggcggagggaccaaggtggagatcaaacgaactgt

SEQ ID NO: 545715 - DNA, 478 bp, Homo sapiens
  misc_feature: HIJSMM301BK2XY.13.39.D06.1.454.light.4.raw
tcacgtactacacgaccggtgctcgatttagtgacatctcgcagttctttggggggggtctcaggaggcagcactctcgggacgtctccaccatggcctgggctctgctcctcctcagcctcctcactcagggcacaggatcctgggctcagtctgccctgactcagcctcgctcagtgtccgggcctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcct

SEQ ID NO: 545716 - DNA, 510 bp, Homo sapiens
  misc_feature: HIJSMM301DG9EJ.5.58.F03.1.454.light.4.raw
atcagacacgcacgaccggtgctcgatttagtctgatcgagaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgattttactgctgctcatatgcaggtgatcacacttttatggttcgggactgggaccaaggtcaccgtctaggtcagcccaaggccaaccccactgtcactctcg

SEQ ID NO: 545717 - DNA, 503 bp, Homo sapiens
  misc_feature: HIJSMM301CWLIH.48.62.F07.1.454.light.4.raw
agtatacatacacgaccggtgctcgatttagtagtcgcataaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagtttacgtcggaccttcggccaagggacacgactggagattaaacgaactgtggctgcaccatctgtcttcatcttcccgccta

SEQ ID NO: 545718 - DNA, 481 bp, Homo sapiens; identical to SEQ ID NO: 535993
  misc_feature: HIJSMM301DELZ2.21.25.C03.1.454.light.4.raw

SEQ ID NO: 545719 - DNA, 504 bp, Homo sapiens; identical to SEQ ID NO: 535935
  misc_feature: HIJSMM301BM34R.18.78.H01.1.454.light.4.raw

SEQ ID NO: 545720 - DNA, 447 bp, Homo sapiens; identical to SEQ ID NO: 535020
  misc_feature: HIJSMM301BDPPM.18.9.A09.1.454.light.4.raw

SEQ ID NO: 545721 - DNA, 490 bp, Homo sapiens; identical to SEQ ID NO: 535420
  misc_feature: HIJSMM301AYHTV.3.72.G06.1.454.light.4.raw

SEQ ID NO: 545722 - DNA, 486 bp, Homo sapiens; identical to SEQ ID NO: 535458
  misc_feature: HIJSMM301BYEWR.7.75.G09.1.454.light.4.raw

SEQ ID NO: 545723 - DNA, 496 bp, Homo sapiens; identical to SEQ ID NO: 538625
  misc_feature: HIJSMM301B5JC7.2.49.E05.1.454.light.4.raw

SEQ ID NO: 545724 - DNA, 447 bp, Homo sapiens; identical to SEQ ID NO: 535020
  misc_feature: HIJSMM301EBLN0.18.9.A09.1.454.light.4.raw

SEQ ID NO: 545725 - DNA, 505 bp, Homo sapiens
  misc_feature: HIJSMM301BO95U.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttgcaatataccgaggacgttcggtcaagggaccaaggtggaggatcaaacgaactgtggctgcaccaatctgtcttcatcttcccgcc

SEQ ID NO: 545726 - DNA, 483 bp, Homo sapiens
  misc_feature: HIJSMM301DMOV6.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcaccat

SEQ ID NO: 545727 - DNA, 497 bp, Homo sapiens
  misc_feature: HIJSMM301AYBPS.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgacctggagattaaaacgaactgtggctgcaccatctgtt

SEQ ID NO: 545728 - DNA, 444 bp, Homo sapiens; identical to SEQ ID NO: 535594
  misc_feature: HIJSMM301BWE19.9.9.A09.1.454.light.4.raw

SEQ ID NO: 545729 - DNA, 516 bp, Homo sapiens
  misc_feature: HIJSMM301CLFWH.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctgccccctcggtcactctcgttcccaccctcctcagacgtatcac

SEQ ID NO: 545730 - DNA, 453 bp, Homo sapiens
  misc_feature: HIJSMM301BMLGE.18.9.A09.1.454.light.4.raw
tacgagtatgcacgaccggtgctcgatttagcgagacgcgcagggtccgtgggcccagtctgtgctgacgcagccgccctccagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtcctggcacctcagcctccctggccatcactgggctccaggctgaggatgaggctgactattactgccagtcctatgacatgaggctgagtggttcgtatgtcttcggatctgggaccaaggtcaccggtcctaagtcagcccaaggccaacccctctgtcactctgttcccaccctcctccatactcggta

SEQ ID NO: 545731 - DNA, 485 bp, Homo sapiens; identical to SEQ ID NO: 542594
  misc_feature: HIJSMM301CD4Q3.49.28.C06.1.454.light.4.raw

SEQ ID NO: 545732 - DNA, 499 bp, Homo sapiens
  misc_feature: HIJSMM301A8CL6.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgtccccccg

SEQ ID NO: 545733 - DNA, 493 bp, Homo sapiens; identical to SEQ ID NO: 540880
  misc_feature: HIJSMM301BV3D2.40.81.H04.1.454.light.4.raw

SEQ ID NO: 545734 - DNA, 443 bp, Homo sapiens; identical to SEQ ID NO: 544936
  misc_feature: HIJSMM301DERYN.2.76.G10.1.454.light.4.raw

SEQ ID NO: 545735 - DNA, 506 bp, Homo sapiens
  misc_feature: HIJSMM301CWL2E.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcaccatctgtcttcatcttcccgccat

SEQ ID NO: 545736 - DNA, 501 bp, Homo sapiens; identical to SEQ ID NO: 535746
  misc_feature: HIJSMM301DK6Y3.18.11.A11.1.454.light.4.raw

SEQ ID NO: 545737 - DNA, 516 bp, Homo sapiens
  misc_feature: HIJSMM301AUGVV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcc

SEQ ID NO: 545738 - DNA, 511 bp, Homo sapiens
  misc_feature: HIJSMM301CDNA9.17.62.F07.1.454.light.4.raw
cgtagactagcacgaccggtgctcgatttagtagtcgcataaagggaaaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcctagtctacg

SEQ ID NO: 545739 - DNA, 481 bp, Homo sapiens
  misc_feature: HIJSMM301CEE5O.41.61.F06.1.454.light.4.raw
tctatactatcacgaccggtgctcgatttagctacgctctaagggaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgactcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctgacagtttccccttcaccttcggccaagggacacgactggacattaaacgaactgtggctgcacc

SEQ ID NO: 545740 - DNA, 486 bp, Homo sapiens
  misc_feature: HIJSMM301DC6GQ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtgctgcaccatctgtcttc

SEQ ID NO: 545741 - DNA, 491 bp, Homo sapiens
  misc_feature: HIJSMM301A0BPA.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtgctgcaccatctgtctt

SEQ ID NO: 545742 - DNA, 444 bp, Homo sapiens; identical to SEQ ID NO: 534993
  misc_feature: HIJSMM301DWQO0.5.9.A09.1.454.light.4.raw

SEQ ID NO: 545743 - DNA, 510 bp, Homo sapiens
  misc_feature: HIJSMM301AZ7XZ.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccaggaccctggagcctcagttggaagcagccgatccagcctgcggagcctgtgggcaggtcagcccaaggccaaccccactgtcactc

SEQ ID NO: 545744 - DNA, 495 bp, Homo sapiens
  misc_feature: HIJSMM301BR08E.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtgggatatcagacgaactgtggctg

SEQ ID NO: 545745 - DNA, 482 bp, Homo sapiens
  misc_feature: HIJSMM301DOMG6.48.35.D02.1.454.light.4.raw
agtatacatacacgaccggtgctcgatttagcacacgatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccacggacagacggccaggatcacgtgctctgcagagacgttgccaagtcaatttggttttggtatcagcagaagtcaggccaggccccaagactgctcatgtatagagacagtgagagggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 545746 - DNA, 505 bp, Homo sapiens
  misc_feature: HIJSMM301C28V9.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggtactgggaccaagaatcaccgtccctaggtcagcccaacggcaaccccaacctcgt

SEQ ID NO: 545747 - DNA, 509 bp, Homo sapiens
  misc_feature: HIJSMM301BLZ80.10.71.G05.1.454.light.4.raw
catagtagtgcacgaccggtgctcgatttagtgtcgtcgcaagagagaggggggacgtgctcagttaggacccacgagggaaccatggaagccccacgctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccccg

SEQ ID NO: 545748 - DNA, 506 bp, Homo sapiens
  misc_feature: HIJSMM301C92XP.4.71.G05.1.454.light.4.raw
  modified_base (320)..(320): a, c, t, g, unknown or other
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctnagagattctctggctccagctcagggactatggccaccttgactatcagtgggcccaagtggaggatgaagctgactactactgttactcaatagagaacagtgataatttctgggtgttcggcggaggaccaaactgaccgtcctaggtcagccaaggctgccccctcggtcactctgttccccg

SEQ ID NO: 545749 - DNA, 509 bp, Homo sapiens; identical to SEQ ID NO: 544573
  misc_feature: HIJSMM301A9SOE.10.88.H11.1.454.light.4.raw

SEQ ID NO: 545750 - DNA, 487 bp, Homo sapiens
  misc_feature: HIJSMM301DXMSL.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcaggtggaggctgaggatgtcgggtttactactgcatgcagggtacactctggccgttcacttttggccagggaccaaactggatatcagacgaactgtggctgca

SEQ ID NO: 545751 - DNA, 487 bp, Homo sapiens
  misc_feature: HIJSMM301BHAV4.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccgaagctggagatcaaacgaactgtggctgcaccat

SEQ ID NO: 545752 - DNA, 513 bp, Homo sapiens
  misc_feature: HIJSMM301D3T2W.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccacctcct

SEQ ID NO: 545753 - DNA, 488 bp, Homo sapiens
  misc_feature: HIJSMM301BZA1M.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggaggatcaaacgtaacg

SEQ ID NO: 545754 - DNA, 503 bp, Homo sapiens
  misc_feature: HIJSMM301DDTSM.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcta

SEQ ID NO: 545755 - DNA, 444 bp, Homo sapiens; identical to SEQ ID NO: 534993
  misc_feature: HIJSMM301EITFO.5.9.A09.1.454.light.4.raw

SEQ ID NO: 545756 - DNA, 502 bp, Homo sapiens
  misc_feature: HIJSMM301CXJO1.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcgggtggttcggcgggggaccaaggctgaccgtcctaggtcagcccaaggctcgcccccgtcggtcactctgttt

SEQ ID NO: 545757 - DNA, 487 bp, Homo sapiens
  misc_feature: HIJSMM301A6SB7.49.3.A03.1.454.light.4.raw
agtcgagagacacgaccggtgctcgatttagagagcgtcacagggggaggaactgctcagttaggacccagacggaaccatggaagccccagcgcagcttctcttcctcctgctactctggctcccagataccactggagaaatagtgatgacgcagtctccagccactttgtctgtgtctccaggggagagagccactctctcctgcaggaccagtcagagtgttaataacaagttagcctggtaccagcagagacctggccaggctcccaggctcctcatctatgatgtgtctaccagggccactggtatcccagccaggttcagtggcagtgggtctggggcggagttcactctcaccatcagcagcctgcagtctgaagattttgcagtttattactgtcagcactctaatgactggcccctgtacacttttggcccggggaccaaggtggagatcaaacgaactgtggctgcaccatctgtt

SEQ ID NO: 545758 - DNA, 505 bp, Homo sapiens; identical to SEQ ID NO: 535987
  misc_feature: HIJSMM301ESE43.18.37.D04.1.454.light.4.raw

SEQ ID NO: 545759 - DNA, 501 bp, Homo sapiens; identical to SEQ ID NO: 535746
  misc_feature: HIJSMM301D3VQG.18.11.A11.1.454.light.4.raw

SEQ ID NO: 545760 - DNA, 506 bp, Homo sapiens
  misc_feature: HIJSMM301DE97U.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctggctccaggctgaggacgaggctgattactactgctgctcatatgcaggtcgtatctcttatgtcttcggaactgggaccaaggtcaccgtcctaggtcagcccaaggcccaaccccactgtcta

SEQ ID NO: 545761 - DNA, 494 bp, Homo sapiens; identical to SEQ ID NO: 534994
  misc_feature: HIJSMM301AQPPB.27.78.H01.1.454.light.4.raw

SEQ ID NO: 545762 - DNA, 496 bp, Homo sapiens; identical to SEQ ID NO: 535109
  misc_feature: HIJSMM301ENZSH.16.78.H01.1.454.light.4.raw

SEQ ID NO: 545763 - DNA, 488 bp, Homo sapiens; identical to SEQ ID NO: 537260
  misc_feature: HIJSMM301ETJH1.47.70.G04.1.454.light.4.raw

SEQ ID NO: 545764 - DNA, 495 bp, Homo sapiens
  misc_feature: HIJSMM301BO33E.47.64.F09.1.454.light.4.raw
  modified_base (481)..(481): a, c, t, g, unknown or other
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggtcggagggaccagggtggagatcaaacgaaactgtggcgtgcnccatctgtcttcat

SEQ ID NO: 545765 - DNA, 499 bp, Homo sapiens
  misc_feature: HIJSMM301CN5GG.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttctaagatattcggcggaggaccaggctgaccgtcctgagtcagcccaaggctgccccctcc

SEQ ID NO: 545766 - DNA, 491 bp, Homo sapiens; identical to SEQ ID NO: 542796
  misc_feature: HIJSMM301AZK5F.19.57.F02.1.454.light.4.raw

SEQ ID NO: 545767 - DNA, 486 bp, Homo sapiens
  misc_feature: HIJSMM301EC7KC.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagcccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtgctgcaccat

SEQ ID NO: 545768 - DNA, 499 bp, Homo sapiens
  misc_feature: HIJSMM301DR7UH.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctgtt

SEQ ID NO: 545769 - DNA, 509 bp, Homo sapiens; identical to SEQ ID NO: 541829
  misc_feature: HIJSMM301DQKC0.17.28.C06.1.454.light.4.raw

SEQ ID NO: 545770 - DNA, 498 bp, Homo sapiens
  misc_feature: HIJSMM301B46MD.51.6.A06.1.454.light.4.raw
cgatcgtatacacgaccggtgctcgatttagatctactgacagggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggtaactagggaccaaggtcaccgtcctaggtcagcccaacggaccaaccccacctacgtcta

SEQ ID NO: 545771 - DNA, 480 bp, Homo sapiens; identical to SEQ ID NO: 535291
  misc_feature: HIJSMM301DOEOD.22.59.F04.1.454.light.4.raw

SEQ ID NO: 545772 - DNA, 491 bp, Homo sapiens
  misc_feature: HIJSMM301CX4DJ.5.14.B03.1.454.light.4.raw
atcagacacgcacgaccggtgctcgatttagtgtgagtagttccgcgggggagtcagacccagtcaggacacagcatggacatgagggtccccgctcagctcctggggctcctgctgctctggttcccaggttccagatgcgacatccagatgacccagtctccttctttcgtttctgcatctgtaggagacagacttactctcacttgtcgggcgagtcacgatattagtaccaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaagtggagatcaaacgaactgtggctgcaccatctgtcttcta

SEQ ID NO: 545773 - DNA, 495 bp, Homo sapiens
  misc_feature: HIJSMM301ERRKG.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcccaagggacacgactggagattaaacgaactgtggctgcaccatctgtctt

SEQ ID NO: 545774 - DNA, 513 bp, Homo sapiens; identical to SEQ ID NO: 535244
  misc_feature: HIJSMM301B2PS3.17.33.C11.1.454.light.4.raw

SEQ ID NO: 545775 - DNA, 489 bp, Homo sapiens; identical to SEQ ID NO: 544819
  misc_feature: HIJSMM301AELUA.11.28.C06.1.454.light.4.raw

SEQ ID NO: 545776 - DNA, 447 bp, Homo sapiens; identical to SEQ ID NO: 535020
  misc_feature: HIJSMM301AL1AZ.18.9.A09.1.454.light.4.raw

SEQ ID NO: 545777 - DNA, 486 bp, Homo sapiens
  misc_feature: HIJSMM301AYICK.46.35.D02.1.454.light.4.raw
actagcagtacacgaccggtgctcgatttagcacacgatagtcgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 545778 - DNA, 508 bp, Homo sapiens; identical to SEQ ID NO: 541821
  misc_feature: HIJSMM301A05WX.5.60.F05.1.454.light.4.raw

SEQ ID NO: 545779 - DNA, 474 bp, Homo sapiens
  misc_feature: HIJSMM301CRKFG.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctggggacagattttcactctcgccatcagtagtctgcaacctgatgattttgcaacttactactgtcaacagagttccactaccccaatcactttcggcccctgggactgaagtgcatatgaagagaactgtgg

SEQ ID NO: 545780 - DNA, 441 bp, Homo sapiens; identical to SEQ ID NO: 534971
  misc_feature: HIJSMM301DMEU5.11.3.A03.1.454.light.4.raw

SEQ ID NO: 545781 - DNA, 483 bp, Homo sapiens; identical to SEQ ID NO: 542200
  misc_feature: HIJSMM301BH9HD.7.75.G09.1.454.light.4.raw

SEQ ID NO: 545782 - DNA, 485 bp, Homo sapiens
  misc_feature: HIJSMM301CGGMH.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaagacgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtgg

SEQ ID NO: 545783 - DNA, 494 bp, Homo sapiens; identical to SEQ ID NO: 534992
  misc_feature: HIJSMM301BCJSN.9.1.A01.1.454.light.4.raw

SEQ ID NO: 545784 - DNA, 464 bp, Homo sapiens
  misc_feature: HIJSMM301CBCRJ.4.23.C01.1.454.light.4.raw
agcactgtagcacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcttctgtaggagacagagtcaccatcacttgccaggcgagtcaggacattaacaactatttaatttggtatcagcagaaaccaggccatgcccctaggctcctgatctacgatgcatcccatttggaaacaggggtcccatcaaggttcagtggaggtggatatgggacagattttactttcaccatcagcagcctgcagcctgaagatactgcaacatattactgtcaacagtatgataatctgccgctcactttcggcggagggaccaaggtggagatcaagagaa

SEQ ID NO: 545785 - DNA, 460 bp, Homo sapiens; identical to SEQ ID NO: 536053
  misc_feature: HIJSMM301BXPU4.22.28.C06.1.454.light.4.raw

SEQ ID NO: 545786 - DNA, 497 bp, Homo sapiens
  misc_feature: HIJSMM301AM7P0.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 545787 - DNA, 501 bp, Homo sapiens; identical to SEQ ID NO: 536818
  misc_feature: HIJSMM301DECL6.12.82.H05.1.454.light.4.raw

SEQ ID NO: 545788 - DNA, 493 bp, Homo sapiens; identical to SEQ ID NO: 535745
  misc_feature: HIJSMM301BPDYX.47.78.H01.1.454.light.4.raw

SEQ ID NO: 545789 - DNA, 495 bp, Homo sapiens
  misc_feature: HIJSMM301AFMU9.3.23.C01.1.454.light.4.raw
agacgcactccacgaccggtgctcgatttagtacacgtgattagggattgggggagctgctcagttaggacccagagggaaccatggaaaccccagcgcagcttctcttcctcctgctactctggctcccagatacccccggagaaattctttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtgcatccaacagggccactggcatcccagacaggttcagtggcagtgggtctggaacagacttcactctcaccatcagcagactggagcctgaagactttgcagtttattactgtctgcagtatggtacttcactcttggtcaatttcggcggcgggaccaaggtggagatcaaacgaactgtggctgcaccatctgtctt

SEQ ID NO: 545790 - DNA, 460 bp, Homo sapiens
  misc_feature: HIJSMM301AOVAU.22.28.C06.1.454.light.4.raw
  modified_base (442)..(442): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccnccctcctcacgcgtatgt

SEQ ID NO: 545791 - DNA, 497 bp, Homo sapiens
  misc_feature: HIJSMM301EP7DV.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagctttatgttaattcacctccgtcgtacatcttggtccaggggaccaagctggagatcaaacgaactgtggctgcaccatctgtcttcatt

SEQ ID NO: 545792 - DNA, 491 bp, Homo sapiens; identical to SEQ ID NO: 536211
  misc_feature: HIJSMM301B63WA.16.53.E09.1.454.light.4.raw

SEQ ID NO: 545793 - DNA, 489 bp, Homo sapiens; identical to SEQ ID NO: 535139
  misc_feature: HIJSMM301DYAHR.14.55.E11.1.454.light.4.raw

SEQ ID NO: 545794 - DNA, 489 bp, Homo sapiens; identical to SEQ ID NO: 543809
  misc_feature: HIJSMM301CFZ5V.19.71.G05.1.454.light.4.raw

SEQ ID NO: 545795 - DNA, 447 bp, Homo sapiens; identical to SEQ ID NO: 535882
  misc_feature: HIJSMM301AESUB.18.9.A09.1.454.light.4.raw
  modified_base (429)..(429): a, c, t, g, unknown or other

SEQ ID NO: 545796 - DNA, 493 bp, Homo sapiens
  misc_feature: HIJSMM301C5IL7.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggtcggagggaccgaaggacggagatcagacgaactgtggctgcaccactctcgtcttcta

SEQ ID NO: 545797 - DNA, 503 bp, Homo sapiens
  misc_feature: HIJSMM301D0MLY.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactatgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggt

SEQ ID NO: 545798 - DNA, 475 bp, Homo sapiens
  misc_feature: HIJSMM301DDD7I.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaccagggaaagccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgtttttggtccaggggaccgaaggtggaggatcaaacgaactgtggctgcaccat

SEQ ID NO: 545799 - DNA, 493 bp, Homo sapiens; identical to SEQ ID NO: 535657
  misc_feature: HIJSMM301BICK2.27.78.H01.1.454.light.4.raw

SEQ ID NO: 545800 - DNA, 472 bp, Homo sapiens; identical to SEQ ID NO: 535584
  misc_feature: HIJSMM301D35Z8.11.17.B06.1.454.light.4.raw

SEQ ID NO: 545801 - DNA, 499 bp, Homo sapiens
  misc_feature: HIJSMM301CTIHE.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcatcttcccgccatctgac

SEQ ID NO: 545802 - DNA, 512 bp, Homo sapiens; identical to SEQ ID NO: 541300
  misc_feature: HIJSMM301EVL22.17.33.C11.1.454.light.4.raw

SEQ ID NO: 545803 - DNA, 484 bp, Homo sapiens
  misc_feature: HIJSMM301AIR2W.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccacatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 545804 - DNA, 487 bp, Homo sapiens
  misc_feature: HIJSMM301B6PCD.14.53.E09.1.454.light.4.raw
cgtctagtaccacgaccggtgctcgatttagagagagtgtgttgggtttgggggggaggcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtccta

SEQ ID NO: 545805 - DNA, 486 bp, Homo sapiens
  misc_feature: HIJSMM301AZ99F.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggctagtttgggtgttcggcggagggaccaagttgaccgtctaggtcagcccaaggctcg

SEQ ID NO: 545806 - DNA, 504 bp, Homo sapiens; identical to SEQ ID NO: 537659
  misc_feature: HIJSMM301B0ZRT.13.55.E11.1.454.light.4.raw

SEQ ID NO: 545807 - DNA, 447 bp, Homo sapiens; identical to SEQ ID NO: 535020
  misc_feature: HIJSMM301D7LWE.18.9.A09.1.454.light.4.raw

SEQ ID NO: 545808 - DNA, 494 bp, Homo sapiens; identical to SEQ ID NO: 535629
  misc_feature: HIJSMM301CUZEB.4.27.C05.1.454.light.4.raw

SEQ ID NO: 545809 - DNA, 451 bp, Homo sapiens
  misc_feature: HIJSMM301CW79M.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgctgctcatttgcaggcgcctacacttgggtgttcggcggagggaccaagctgaccgtcctaggtcagcccaaggctgccccctcggtcactctgttcccaccctcctcacgcgtatgt

SEQ ID NO: 545810 - DNA, 475 bp, Homo sapiens
  misc_feature: HIJSMM301BT1IN.41.5.A05.1.454.light.4.raw
tctatactatcacgaccggtgctcgatttagatagatagacaggggagtcagacccagtcaggacacagcatggacatgagggtcccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcaccat

SEQ ID NO: 545811 - DNA, 496 bp, Homo sapiens
  misc_feature: HIJSMM301ERUZ2.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggcgtgcaccatctgtctt

SEQ ID NO: 545812 - DNA, 444 bp, Homo sapiens; identical to SEQ ID NO: 535856
  misc_feature: HIJSMM301DKZWP.9.9.A09.1.454.light.4.raw

SEQ ID NO: 545813 - DNA, 497 bp, Homo sapiens; identical to SEQ ID NO: 536371
  misc_feature: HIJSMM301AK4GR.16.78.H01.1.454.light.4.raw

SEQ ID NO: 545814 - DNA, 494 bp, Homo sapiens; identical to SEQ ID NO: 541035
  misc_feature: HIJSMM301BZNSQ.26.12.B01.1.454.light.4.raw

SEQ ID NO: 545815 - DNA, 489 bp, Homo sapiens
  misc_feature: HIJSMM301BCSS0.4.24.C02.1.454.light.4.raw
agcactgtagcacgaccggtgctcgatttagtacagatcgttagggaaagggggagtcagactcagtcaggacacagcatggacatgagggtccccgctcagctcctggggctcctgctgctctggctcccaggtgccaaatgtgacgtccagatgacccagtctccttccaccctgtctgcatctataggagacagagtcaccatcacttgccgggccagtcagagtattagtaactggttggcctggtatcagcagaaaccaggcaaagccccaaaactccttatctctgatgcctccactttgcacggtggggtcccaccaacgttcagcggcagtgggtctgggacagaattcactctcaccatcagcagcctgcaacctgatgatgttgcaacttattactgtcaacaatataacagttattggacgttcggccaagggaccaaggtggaaatcagacgaactgtggctgcaccatctgtcttc

SEQ ID NO: 545816 - DNA, 495 bp, Homo sapiens; identical to SEQ ID NO: 535821
  misc_feature: HIJSMM301BH0PK.3.31.C09.1.454.light.4.raw

SEQ ID NO: 545817 - DNA, 510 bp, Homo sapiens; identical to SEQ ID NO: 538614
  misc_feature: HIJSMM301DT3QB.19.59.F04.1.454.light.4.raw

SEQ ID NO: 545818 - DNA, 500 bp, Homo sapiens
  misc_feature: HIJSMM301BO7XP.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccatcc

SEQ ID NO: 545819 - DNA, 520 bp, Homo sapiens; identical to SEQ ID NO: 539176
  misc_feature: HIJSMM301AJLN5.27.23.C01.1.454.light.4.raw

SEQ ID NO: 545820 - DNA, 504 bp, Homo sapiens; identical to SEQ ID NO: 538940
  misc_feature: HIJSMM301ECB0M.2.35.D02.1.454.light.4.raw

SEQ ID NO: 545821 - DNA, 445 bp, Homo sapiens
  misc_feature: HIJSMM301BR2TQ.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtcggtattcggcggagggaccaagctgaccgtcctaggtcagcccaaggctgccccctcggtcactctgttcccaccctcctcagacgtatca

SEQ ID NO: 545822 - DNA, 444 bp, Homo sapiens
  misc_feature: HIJSMM301BSWSB.8.11.A11.1.454.light.4.raw
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgccccctcggtcactctgttcccaccctcctcgacacgcgag

SEQ ID NO: 545823 - DNA, 483 bp, Homo sapiens
  misc_feature: HIJSMM301CLNKP.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcac

SEQ ID NO: 545824 - DNA, 497 bp, Homo sapiens; identical to SEQ ID NO: 537288
  misc_feature: HIJSMM301DHTQ7.15.25.C03.1.454.light.4.raw

SEQ ID NO: 545825 - DNA, 494 bp, Homo sapiens
  misc_feature: HIJSMM301CIANX.48.48.E04.1.454.light.4.raw
agtatacatacacgaccggtgctcgatttagagagcgtcacagagagaaggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 545826 - DNA, 447 bp, Homo sapiens; identical to SEQ ID NO: 535201
  misc_feature: HIJSMM301ESRXA.18.9.A09.1.454.light.4.raw

SEQ ID NO: 545827 - DNA, 447 bp, Homo sapiens; identical to SEQ ID NO: 535020
  misc_feature: HIJSMM301DNA85.18.9.A09.1.454.light.4.raw

SEQ ID NO: 545828 - DNA, 501 bp, Homo sapiens
  misc_feature: HIJSMM301DM4PT.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaaggtggaaatacaaacgaactacgtggctgcaccatctgtctttcatt

SEQ ID NO: 545829 - DNA, 503 bp, Homo sapiens; identical to SEQ ID NO: 535044
  misc_feature: HIJSMM301CM135.19.78.H01.1.454.light.4.raw

SEQ ID NO: 545830 - DNA, 476 bp, Homo sapiens; identical to SEQ ID NO: 539512
  misc_feature: HIJSMM301CHH4O.8.85.H08.1.454.light.4.raw

SEQ ID NO: 545831 - DNA, 518 bp, Homo sapiens; identical to SEQ ID NO: 539372
  misc_feature: HIJSMM301BIN63.7.86.H09.1.454.light.4.raw

SEQ ID NO: 545832 - DNA, 489 bp, Homo sapiens
  misc_feature: HIJSMM301B2ROV.5.40.D07.1.454.light.4.raw
atcagacacgcacgaccggtgctcgatttagtgatagagcgtaacaacagagggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggt

SEQ ID NO: 545833 - DNA, 439 bp, Homo sapiens
  misc_feature: HIJSMM301AWTFT.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatctct

SEQ ID NO: 545834 - DNA, 516 bp, Homo sapiens
  misc_feature: HIJSMM301DW9L2.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggaggggaccgaaacgctcgaccgtccctgggtcgagcccaacggctgccccctccggtcactctgttcccaaccctcctcctacgtcgtat

SEQ ID NO: 545835 - DNA, 487 bp, Homo sapiens; identical to SEQ ID NO: 536536
  misc_feature: HIJSMM301DJ5J1.26.45.E01.1.454.light.4.raw

SEQ ID NO: 545836 - DNA, 486 bp, Homo sapiens; identical to SEQ ID NO: 535290
  misc_feature: HIJSMM301BKFQ6.3.12.B01.1.454.light.4.raw

SEQ ID NO: 545837 - DNA, 509 bp, Homo sapiens
  misc_feature: HIJSMM301A12K4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccaacgggaccgaaggtaggaaatacaaacgaactagtggctgcaccatctgtcttctatcttccccg

SEQ ID NO: 545838 - DNA, 503 bp, Homo sapiens; identical to SEQ ID NO: 536002
  misc_feature: HIJSMM301A1MO2.51.23.C01.1.454.light.4.raw

SEQ ID NO: 545839 - DNA, 477 bp, Homo sapiens; identical to SEQ ID NO: 535506
  misc_feature: HIJSMM301DRLS3.7.67.G01.1.454.light.4.raw

SEQ ID NO: 545840 - DNA, 494 bp, Homo sapiens; identical to SEQ ID NO: 534992
  misc_feature: HIJSMM301DQAZ2.9.1.A01.1.454.light.4.raw

SEQ ID NO: 545841 - DNA, 508 bp, Homo sapiens; identical to SEQ ID NO: 536388
  misc_feature: HIJSMM301CPYKY.11.57.F02.1.454.light.4.raw

SEQ ID NO: 545842 - DNA, 485 bp, Homo sapiens
  misc_feature: HIJSMM301DNBC1.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagtattttgcaacttactattgtcaacaggctaacagtttcccgctcaccgttcggcgggggaccgaaggtggagatcaaacgaactgtggctgcaccattc

SEQ ID NO: 545843 - DNA, 469 bp, Homo sapiens
  misc_feature: HIJSMM301B16DE.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggcctggactgaagtgcatatgaagagaactgtgg

SEQ ID NO: 545844 - DNA, 503 bp, Homo sapiens
  misc_feature: HIJSMM301D2E4D.27.78.H01.1.454.light.4.raw
agcgtcgtctcacgaccggtgctcgatttagtgtgagtagtttgggtttggggatcttaaaagaggttctttctctgggatgtgacatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagctaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 545845 - DNA, 481 bp, Homo sapiens
  misc_feature: HIJSMM301EPOGH.48.53.E09.1.454.light.4.raw
agtatacatacacgaccggtgctcgatttagagagagtgtgttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagccc

SEQ ID NO: 545846 - DNA, 512 bp, Homo sapiens; identical to SEQ ID NO: 542831
  misc_feature: HIJSMM301D061R.43.19.B08.1.454.light.4.raw

SEQ ID NO: 545847 - DNA, 444 bp, Homo sapiens; identical to SEQ ID NO: 535594
  misc_feature: HIJSMM301B042T.9.9.A09.1.454.light.4.raw

SEQ ID NO: 545848 - DNA, 496 bp, Homo sapiens; identical to SEQ ID NO: 537925
  misc_feature: HIJSMM301BKXQY.22.14.B03.1.454.light.4.raw

SEQ ID NO: 545849 - DNA, 494 bp, Homo sapiens; identical to SEQ ID NO: 535629
  misc_feature: HIJSMM301BSPD1.4.27.C05.1.454.light.4.raw

SEQ ID NO: 545850 - DNA, 415 bp, Homo sapiens; identical to SEQ ID NO: 536118
  misc_feature: HIJSMM301CMN0K.18.78.H01.1.454.light.4.raw

SEQ ID NO: 545851 - DNA, 504 bp, Homo sapiens
  misc_feature: HIJSMM301B0JWO.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccgccctcc

SEQ ID NO: 545852 - DNA, 454 bp, Homo sapiens; identical to SEQ ID NO: 535005
  misc_feature: HIJSMM301C4Z8B.19.86.H09.1.454.light.4.raw

SEQ ID NO: 545853 - DNA, 504 bp, Homo sapiens
  misc_feature: HIJSMM301B5AOC.21.22.B11.1.454.light.4.raw
  modified_base (330)..(330): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcgagagggtcaccatctcttgttctggaggcaactccaacatcggaagtaattatgtattctggtatcagcaactcccaggaatggcccccaaactcctcatccagaggaataatcagcggccctcaggggtccctnacgattctctggctccaagtctggcacctcagcctccctgaccatcagtgggctccggtccgaggatgaggctgactattactgtgcatcacggggacgcaacatggggatgacaatctggagcggttgggtgttcggcggagggaccaaactgaccgtcctaggtcagcccaa

SEQ ID NO: 545854 - DNA, 503 bp, Homo sapiens
  misc_feature: HIJSMM301DH9TW.47.55.E11.1.454.light.4.raw
agctcacgtacacgaccggtgctcgatttagcactcgcacgttgggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgcttcggagctgggaccaaggtcaccgtctaggtcagcccaaggccaaccc

SEQ ID NO: 545855 - DNA, 492 bp, Homo sapiens
  misc_feature: HIJSMM301CIPPB.49.35.D02.1.454.light.4.raw
agtcgagagacacgaccggtgctcgatttagcacacgatagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 545856 - DNA, 495 bp, Homo sapiens; identical to SEQ ID NO: 538920
  misc_feature: HIJSMM301B22FF.47.64.F09.1.454.light.4.raw

SEQ ID NO: 545857 - DNA, 500 bp, Homo sapiens
  misc_feature: HIJSMM301BATID.16.86.H09.1.454.light.4.raw
tgtactactccacgaccggtgctcgatttagtgctatagacttgggtttgggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgcccccc

SEQ ID NO: 545858 - DNA, 515 bp, Homo sapiens
  misc_feature: HIJSMM301DM4CP.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgaggtgactattctgtcaagtgtgggacaccaacacttgtgtcttcgggactgggaccgaggtcaccgtcctaagtcagcccagggccaacccactgtcactctgttcccaccctcctcgacacg

SEQ ID NO: 545859 - DNA, 491 bp, Homo sapiens; identical to SEQ ID NO: 543793
  misc_feature: HIJSMM301A6201.43.20.B09.1.454.light.4.raw

SEQ ID NO: 545860 - DNA, 487 bp, Homo sapiens; identical to SEQ ID NO: 545757
  misc_feature: HIJSMM301EKWG0.49.3.A03.1.454.light.4.raw

SEQ ID NO: 545861 - DNA, 486 bp, Homo sapiens; identical to SEQ ID NO: 535043
  misc_feature: HIJSMM301C3VU3.46.35.D02.1.454.light.4.raw

SEQ ID NO: 545862 - DNA, 504 bp, Homo sapiens; identical to SEQ ID NO: 535561
  misc_feature: HIJSMM301BAN3F.4.57.F02.1.454.light.4.raw

SEQ ID NO: 545863 - DNA, 489 bp, Homo sapiens; identical to SEQ ID NO: 535139
  misc_feature: HIJSMM301AJ3SD.14.55.E11.1.454.light.4.raw

SEQ ID NO: 545864 - DNA, 505 bp, Homo sapiens; identical to SEQ ID NO: 538224
  misc_feature: HIJSMM301B0GCY.16.46.E02.1.454.light.4.raw

SEQ ID NO: 545865 - DNA, 511 bp, Homo sapiens
  misc_feature: HIJSMM301AGSOC.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcacgtcctaggtcagcccaaggccaaccccactgtcactctgttcccaccctcctcga

SEQ ID NO: 545866 - DNA, 494 bp, Homo sapiens
  misc_feature: HIJSMM301DZ4HO.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaaggaccaaggtggaagtcaaacgaactagtggctgcaccatctgtcttcatcttcccg

SEQ ID NO: 545867 - DNA, 488 bp, Homo sapiens
  misc_feature: HIJSMM301DDZ9X.4.64.F09.1.454.light.4.raw
agcactgtagcacgaccggtgctcgatttagcgcgtatacagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgctaacttacttttgtcaacagactaactcattccctcgcagttttggccaggggaccaaggtggagatacaaacgaactgtggctgcaccatctgtcttcat

SEQ ID NO: 545868 - DNA, 483 bp, Homo sapiens; identical to SEQ ID NO: 540738
  misc_feature: HIJSMM301DYCVI.48.85.H08.1.454.light.4.raw

SEQ ID NO: 545869 - DNA, 441 bp, Homo sapiens; identical to SEQ ID NO: 534971
  misc_feature: HIJSMM301BV0FW.11.3.A03.1.454.light.4.raw

SEQ ID NO: 545870 - DNA, 491 bp, Homo sapiens; identical to SEQ ID NO: 538021
  misc_feature: HIJSMM301BTJEW.3.72.G06.1.454.light.4.raw

SEQ ID NO: 545871 - DNA, 494 bp, Homo sapiens; identical to SEQ ID NO: 534994
  misc_feature: HIJSMM301DITFN.27.78.H01.1.454.light.4.raw

SEQ ID NO: 545872 - DNA, 494 bp, Homo sapiens
  misc_feature: HIJSMM301AUGF5.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccgaaacgtaggacgatcaagcgaactgtggctgcaccatctgt

SEQ ID NO: 545873 - DNA, 505 bp, Homo sapiens
  misc_feature: HIJSMM301BY6CY.48.70.G04.1.454.light.4.raw
agtatacatacacgaccggtgctcgatttagtgtagtgtgaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatctgtt

SEQ ID NO: 545874 - DNA, 509 bp, Homo sapiens
  misc_feature: HIJSMM301BAG77.43.27.C05.1.454.light.4.raw
tgtgagtagtcacgaccggtgctcgatttagacgcgatcgaagggtttggggagagaagacaggattcaggacaatctccagcatggccggcttccctctcctcctcaccctcctcactcactgtgcagggtcctgggcccagtctgtactgactcagccaccctcagcgtctgggacccccgggcagagggtcaccatctcttgttctgggacctactccaacatcggaagtaatactgtaaactggtaccagcagctcccaggaacggcccccaaactcctcatctacagtattaatcagcggccctcagggatccctgaccgattctctggctccaagtctggcgcctcagcctccctggccatcagtgggctccagtctgaggatgaggctgattattactgtgctgcatgggatgacagcctgaatgcttgggtgttcggcggagggaccaagctgaccgtcctaggtcagcccaaggctgccccctcggtcactctgttcccg

SEQ ID NO: 545875 - DNA, 514 bp, Homo sapiens
  misc_feature: HIJSMM301ASHT9.17.37.D04.1.454.light.4.raw
cgtagactagcacgaccggtgctcgatttagtagcatactgttgggtttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccagggcagacggccaggattacctgtgggggaaacaatgttggaagtaaaactgtgcactggtaccagcagaagccaggccaggcccctgtgctggtcgtctatgatgataccgaccggccctcagggatccctgagcgattctctggctccaactctgggaacacggccaccctgaccatcggcagggtcgaagccggggatgaggccgactattattgtcaggtgtgggatagtagtagtgatcatgtggtattcggcggagggaccaagctgaccgtccttggtcagcccaaggctgccccctcggtcactctgttcccta

SEQ ID NO: 545876 - DNA, 504 bp, Homo sapiens; identical to SEQ ID NO: 535561
  misc_feature: HIJSMM301B1S0T.4.57.F02.1.454.light.4.raw

SEQ ID NO: 545877 - DNA, 506 bp, Homo sapiens
  misc_feature: HIJSMM301DKAF5.48.16.B05.1.454.light.4.raw
agtatacatacacgaccggtgctcgatttagagctcacgtaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaacctcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggcggagggaccaaactgaccgtcctcggtcggcccaaggctgccccctcggtcactctcg

SEQ ID NO: 545878 - DNA, 518 bp, Homo sapiens
  misc_feature: HIJSMM301BVGDE.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 545879 - DNA, 487 bp, Homo sapiens; identical to SEQ ID NO: 541444
  misc_feature: HIJSMM301AXXLP.19.71.G05.1.454.light.4.raw

SEQ ID NO: 545880 - DNA, 463 bp, Homo sapiens; identical to SEQ ID NO: 535062
  misc_feature: HIJSMM301CRSI9.11.73.G07.1.454.light.4.raw

SEQ ID NO: 545881 - DNA, 486 bp, Homo sapiens; identical to SEQ ID NO: 535523
  misc_feature: HIJSMM301A4YSD.22.73.G07.1.454.light.4.raw

SEQ ID NO: 545882 - DNA, 482 bp, Homo sapiens
  misc_feature: HIJSMM301ARAU1.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggccg

SEQ ID NO: 545883 - DNA, 493 bp, Homo sapiens
  misc_feature: HIJSMM301CRLTO.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctcgccccctcggtcacttcc

SEQ ID NO: 545884 - DNA, 484 bp, Homo sapiens; identical to SEQ ID NO: 538247
  misc_feature: HIJSMM301DX9SN.14.53.E09.1.454.light.4.raw

SEQ ID NO: 545885 - DNA, 506 bp, Homo sapiens
  misc_feature: HIJSMM301BVVS1.9.53.E09.1.454.light.4.raw
tgatacgtctcacgaccggtgctcgatttagagagagtgtgttgggtttgggggggtcgacaagaggcagcgctctcgggacgtctccaccatggcctgggctctgctgctcctcaccctcctcactcaggacacagggtcctgggcccagtctgccctgactcagcctgcctccgtgtctgggtctcccggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctggcgtccaggctgaggacgaggctgattattactgctgctcatatgcagatggtgacactcccgtggtattcggcggagggaccgaaggtgaccgtcctaggtcagcccaaggctgccccctcc

SEQ ID NO: 545886 - DNA, 480 bp, Homo sapiens
  misc_feature: HIJSMM301BQLM1.51.30.C08.1.454.light.4.raw
cgatcgtatacacgaccggtgctcgatttagtctgacgtcaaagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgtggctgca

SEQ ID NO: 545887 - DNA, 491 bp, Homo sapiens
  misc_feature: HIJSMM301DRBSG.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacacttttggccaggggaccaagctagaatcaaacgaactgtggctgcaccatctgtcttc

SEQ ID NO: 545888 - DNA, 447 bp, Homo sapiens; identical to SEQ ID NO: 535020
  misc_feature: HIJSMM301B0J0H.18.9.A09.1.454.light.4.raw

SEQ ID NO: 545889 - DNA, 488 bp, Homo sapiens
  misc_feature: HIJSMM301BV57N.47.70.G04.1.454.light.4.raw
agctcacgtacacgaccggtgctcgatttagtgtagtgtgaagggaaaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacaaccttttggccaggggaccaaactggacatcaaacgaactgtggctgcaccatctgt

SEQ ID NO: 545890 - DNA, 492 bp, Homo sapiens; identical to SEQ ID NO: 537666
  misc_feature: HIJSMM301EIP1J.43.33.C11.1.454.light.4.raw

SEQ ID NO: 545891 - DNA, 492 bp, Homo sapiens; identical to SEQ ID NO: 543155
  misc_feature: HIJSMM301BKZ6Q.10.53.E09.1.454.light.4.raw

SEQ ID NO: 545892 - DNA, 485 bp, Homo sapiens; identical to SEQ ID NO: 539951
  misc_feature: HIJSMM301AIM9K.4.26.C04.1.454.light.4.raw

SEQ ID NO: 545893 - DNA, 483 bp, Homo sapiens
  misc_feature: HIJSMM301CDXGP.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcgggggaccaaggtggagatcaaacgaactgtggctgcaccta

SEQ ID NO: 545894 - DNA, 488 bp, Homo sapiens; identical to SEQ ID NO: 535861
  misc_feature: HIJSMM301CUXW0.14.55.E11.1.454.light.4.raw

SEQ ID NO: 545895 - DNA, 509 bp, Homo sapiens; identical to SEQ ID NO: 541829
  misc_feature: HIJSMM301ECKY0.17.28.C06.1.454.light.4.raw

SEQ ID NO: 545896 - DNA, 494 bp, Homo sapiens
  misc_feature: HIJSMM301D4OOI.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggaggatcaacgaactgtggctgcaccatctgtctt

SEQ ID NO: 545897 - DNA, 490 bp, Homo sapiens; identical to SEQ ID NO: 535936
  misc_feature: HIJSMM301C7Y1X.16.68.G02.1.454.light.4.raw

SEQ ID NO: 545898 - DNA, 486 bp, Homo sapiens
  misc_feature: HIJSMM301DJZA6.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacggaactgtggctgcaccatctgt

SEQ ID NO: 545899 - DNA, 500 bp, Homo sapiens
  misc_feature: HIJSMM301AQ131.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccagggtccaagctggagatgaaacgaactgtggctgcaccatctgtcttcatcttccccg

SEQ ID NO: 545900 - DNA, 495 bp, Homo sapiens
  misc_feature: HIJSMM301B7FR0.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaacccca

SEQ ID NO: 545901 - DNA, 447 bp, Homo sapiens; identical to SEQ ID NO: 535201
  misc_feature: HIJSMM301AQBQ7.18.9.A09.1.454.light.4.raw

SEQ ID NO: 545902 - DNA, 416 bp, Homo sapiens
  misc_feature: HIJSMM301A95CQ.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 545903 - DNA, 497 bp, Homo sapiens; identical to SEQ ID NO: 538296
  misc_feature: HIJSMM301DQOIT.18.11.A11.1.454.light.4.raw

SEQ ID NO: 545904 - DNA, 496 bp, Homo sapiens; identical to SEQ ID NO: 535109
  misc_feature: HIJSMM301CW1Z3.16.78.H01.1.454.light.4.raw

SEQ ID NO: 545905 - DNA, 522 bp, Homo sapiens
  misc_feature: HIJSMM301BJQNW.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgtaatcgtcttctctggctccaagtctggcgacacggcctccctcgaccatctctgggcgtccacggctgaagacgaggctgattattactgcagctcatatacaggcagcagcactcacgggttttcgggtccggaggggacccaaagcgtgacccggttcctacggtcagccccaacggctcgccccctcccggt

SEQ ID NO: 545906 - DNA, 520 bp, Homo sapiens; identical to SEQ ID NO: 537173
  misc_feature: HIJSMM301BVC9V.27.23.C01.1.454.light.4.raw

SEQ ID NO: 545907 - DNA, 471 bp, Homo sapiens; identical to SEQ ID NO: 540579
  misc_feature: HIJSMM301A27LC.3.82.H05.1.454.light.4.raw

SEQ ID NO: 545908 - DNA, 500 bp, Homo sapiens
  misc_feature: HIJSMM301BELM1.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccactgtcactctgttcccaccctcctcgtatctctcg

SEQ ID NO: 545909 - DNA, 523 bp, Homo sapiens
  misc_feature: HIJSMM301BHZVO.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaagggaccgaacggtaggaaggtacgaaacgaaccgtagtggcgtgcaccatactgttcttctactcttcccgtcccact

SEQ ID NO: 545910 - DNA, 465 bp, Homo sapiens
  misc_feature: HIJSMM301DIFWO.52.9.A09.1.454.light.4.raw
cgcagtacgacacgaccggtgctcgatttagcgagacgcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaagccagggaaagcccctaaactcctgatctctgctgcatctagtttgcatactgaggtcccatccaggttcagtggcggtggatctgggacagatttcactctcaccatcagcagtctgcaacctgaagattttgcaacttactactgtcaacagggttacggaaccctgctcatcttcggcgagggaccaaggtggagatcaaacgaa

SEQ ID NO: 545911 - DNA, 460 bp, Homo sapiens; identical to SEQ ID NO: 536053
  misc_feature: HIJSMM301C18WY.22.28.C06.1.454.light.4.raw

SEQ ID NO: 545912 - DNA, 496 bp, Homo sapiens
  misc_feature: HIJSMM301AM2VE.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgttcagcaatatggtaggtcacctgggacttttggccaggggaccaagctggagatcaaacgaactgtggctgcaccatctgtctt

SEQ ID NO: 545913 - DNA, 472 bp, Homo sapiens
  misc_feature: HIJSMM301AR766.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcggggggaccgaacgtggacgatcaacgaa

SEQ ID NO: 545914 - DNA, 521 bp, Homo sapiens
  misc_feature: HIJSMM301DDHG6.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 545915 - DNA, 495 bp, Homo sapiens
  misc_feature: HIJSMM301AD8VG.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcagtgatcacctcggtccaagggacgacgactggagattaaacgaactgtggctgcaccatctgttctt

SEQ ID NO: 545916 - DNA, 484 bp, Homo sapiens; identical to SEQ ID NO: 535400
  misc_feature: HIJSMM301BT0K7.46.26.C04.1.454.light.4.raw

SEQ ID NO: 545917 - DNA, 481 bp, Homo sapiens
  misc_feature: HIJSMM301EK22C.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctc

SEQ ID NO: 545918 - DNA, 484 bp, Homo sapiens
  misc_feature: HIJSMM301BU00H.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatagttactccttcactttcggccctggaccaaagtggacatcaaacgaactgtggctgcacatctgtctt

SEQ ID NO: 545919 - DNA, 479 bp, Homo sapiens
  misc_feature: HIJSMM301A5PWH.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggct

SEQ ID NO: 545920 - DNA, 487 bp, Homo sapiens; identical to SEQ ID NO: 541187
  misc_feature: HIJSMM301ELL1N.43.36.D03.1.454.light.4.raw

SEQ ID NO: 545921 - DNA, 500 bp, Homo sapiens
  misc_feature: HIJSMM301DOM4J.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaaatattatattcctcctcagacgttcggccaagggaccaaggtggaaatcaaacgaactgtggctgcacca

SEQ ID NO: 545922 - DNA, 495 bp, Homo sapiens; identical to SEQ ID NO: 542410
  misc_feature: HIJSMM301A0AP5.26.12.B01.1.454.light.4.raw

SEQ ID NO: 545923 - DNA, 499 bp, Homo sapiens
  misc_feature: HIJSMM301CPDZO.2.76.G10.1.454.light.4.raw
acgctcgacacacgaccggtgctcgatttagtcactcatacagggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctcctggccatcagtgggctccgggccgaggatgaggctgattattactgtgcaggatgggatgacaacctgggtgcttatctcttcggacctgggaccaaggtcaccgtctggt

SEQ ID NO: 545924 - DNA, 505 bp, Homo sapiens; identical to SEQ ID NO: 535503
  misc_feature: HIJSMM301B06SQ.8.28.C06.1.454.light.4.raw

SEQ ID NO: 545925 - DNA, 493 bp, Homo sapiens; identical to SEQ ID NO: 536534
  misc_feature: HIJSMM301AQ7M8.43.72.G06.1.454.light.4.raw

SEQ ID NO: 545926 - DNA, 485 bp, Homo sapiens
  misc_feature: HIJSMM301ETV1K.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagacgaactgtggcg

SEQ ID NO: 545927 - DNA, 493 bp, Homo sapiens; identical to SEQ ID NO: 544835
  misc_feature: HIJSMM301DKWWS.43.29.C07.1.454.light.4.raw

SEQ ID NO: 545928 - DNA, 495 bp, Homo sapiens
  misc_feature: HIJSMM301A7YY6.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatggttggggtttattactgcatgcaagctctacaacctctgcggactttcggccctcggaccgaaacg

SEQ ID NO: 545929 - DNA, 491 bp, Homo sapiens
  misc_feature: HIJSMM301DYHK9.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtgg

SEQ ID NO: 545930 - DNA, 521 bp, Homo sapiens; identical to SEQ ID NO: 538715
  misc_feature: HIJSMM301DEKWL.27.23.C01.1.454.light.4.raw

SEQ ID NO: 545931 - DNA, 504 bp, Homo sapiens
  misc_feature: HIJSMM301CK9I6.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctcggggccactttcggccctggaccaagtggatatcaaacgaactgtggctgcaccatctgtcttcta

SEQ ID NO: 545932 - DNA, 503 bp, Homo sapiens
  misc_feature: HIJSMM301ATW2K.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtcctaggtcagcccaaggccaaccccactgtca

SEQ ID NO: 545933 - DNA, 485 bp, Homo sapiens
  misc_feature: HIJSMM301CXA94.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacggactggagattaaacgaactgtggctgcaccat

SEQ ID NO: 545934 - DNA, 500 bp, Homo sapiens; identical to SEQ ID NO: 540836
  misc_feature: HIJSMM301A2H70.3.10.A10.1.454.light.4.raw

SEQ ID NO: 545935 - DNA, 461 bp, Homo sapiens
  misc_feature: HIJSMM301AVNYU.13.34.D01.1.454.light.4.raw
tcacgtactacacgaccggtgctcgatttagatcgtctgtgttgggtttgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtattcggcgggggaccgac

SEQ ID NO: 545936 - DNA, 478 bp, Homo sapiens; identical to SEQ ID NO: 543315
  misc_feature: HIJSMM301A6GLX.26.72.G06.1.454.light.4.raw

SEQ ID NO: 545937 - DNA, 463 bp, Homo sapiens
  misc_feature: HIJSMM301CTX54.17.28.C06.1.454.light.4.raw
cgtagactagcacgaccggtgctcgatttagagctcacgtattgggtttgggggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccaccctcctcctagtctacg

SEQ ID NO: 545938 - DNA, 505 bp, Homo sapiens; identical to SEQ ID NO: 535503
  misc_feature: HIJSMM301D5XNA.8.28.C06.1.454.light.4.raw

SEQ ID NO: 545939 - DNA, 447 bp, Homo sapiens; identical to SEQ ID NO: 535201
  misc_feature: HIJSMM301BKPOW.18.9.A09.1.454.light.4.raw

SEQ ID NO: 545940 - DNA, 496 bp, Homo sapiens; identical to SEQ ID NO: 535541
  misc_feature: HIJSMM301DPHE6.3.33.C11.1.454.light.4.raw

SEQ ID NO: 545941 - DNA, 501 bp, Homo sapiens
  misc_feature: HIJSMM301DF3TD.21.22.B11.1.454.light.4.raw
  modified_base (460)..(460): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggngttcggcggagggaccaaactgaccgtctaggtcagcccaa

SEQ ID NO: 545942 - DNA, 509 bp, Homo sapiens; identical to SEQ ID NO: 542468
  misc_feature: HIJSMM301D7XMF.8.33.C11.1.454.light.4.raw

SEQ ID NO: 545943 - DNA, 493 bp, Homo sapiens; identical to SEQ ID NO: 535614
  misc_feature: HIJSMM301DOURE.9.1.A01.1.454.light.4.raw

SEQ ID NO: 545944 - DNA, 484 bp, Homo sapiens
  misc_feature: HIJSMM301B3MF1.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggaccaagctggagatcaaacgaactgtggctgcaccat

SEQ ID NO: 545945 - DNA, 418 bp, Homo sapiens
  misc_feature: HIJSMM301C1AS1.41.73.G07.1.454.light.4.raw
tctatactatcacgaccggtgctcgatttagctctacgctcagggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 545946 - DNA, 513 bp, Homo sapiens
  misc_feature: HIJSMM301DAOU9.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtcctaagtcagcccaaggctgccccctcggtcactctgttccccg

SEQ ID NO: 545947 - DNA, 489 bp, Homo sapiens
  misc_feature: HIJSMM301ENHKC.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttacttcggccctgggaccaaagtggatatcaacgaactgtggctgcaccat

SEQ ID NO: 545948 - DNA, 485 bp, Homo sapiens; identical to SEQ ID NO: 536040
  misc_feature: HIJSMM301BEUIY.15.1.A01.1.454.light.4.raw

SEQ ID NO: 545949 - DNA, 484 bp, Homo sapiens
  misc_feature: HIJSMM301C9M8D.48.22.B11.1.454.light.4.raw
agtatacatacacgaccggtgctcgatttagacgacagctcagggggagtcagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccaggggaccaaggtggagatcaaacgaactgtggctgcaccatctgt

SEQ ID NO: 545950 - DNA, 490 bp, Homo sapiens
  misc_feature: HIJSMM301CMNO6.47.78.H01.1.454.light.4.raw
agctcacgtacacgaccggtgctcgatttagtgtgagtagtttgggtttgggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttgggttgttcctccatgcaaggtacacactggccttttggccaggggaccaacctggagatcaaatgaactgtggctgcaccatctgtctt

SEQ ID NO: 545951 - DNA, 498 bp, Homo sapiens; identical to SEQ ID NO: 536173
  misc_feature: HIJSMM301DZF98.12.86.H09.1.454.light.4.raw

SEQ ID NO: 545952 - DNA, 494 bp, Homo sapiens; identical to SEQ ID NO: 534992
  misc_feature: HIJSMM301AIFS8.9.1.A01.1.454.light.4.raw

SEQ ID NO: 545953 - DNA, 504 bp, Homo sapiens
  misc_feature: HIJSMM301EAQ3S.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatcttcccgcc

SEQ ID NO: 545954 - DNA, 494 bp, Homo sapiens; identical to SEQ ID NO: 537091
  misc_feature: HIJSMM301CFFKR.27.78.H01.1.454.light.4.raw
  modified_base (426)..(426): a, c, t, g, unknown or other

SEQ ID NO: 545955 - DNA, 499 bp, Homo sapiens; identical to SEQ ID NO: 536578
  misc_feature: HIJSMM301CM1H3.22.27.C05.1.454.light.4.raw

SEQ ID NO: 545956 - DNA, 483 bp, Homo sapiens; identical to SEQ ID NO: 535317
  misc_feature: HIJSMM301BO8JB.4.1.A01.1.454.light.4.raw

SEQ ID NO: 545957 - DNA, 513 bp, Homo sapiens
  misc_feature: HIJSMM301EI0DE.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccgccctcctcga

SEQ ID NO: 545958 - DNA, 492 bp, Homo sapiens
  misc_feature: HIJSMM301A7BXA.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaaacgaactgt

SEQ ID NO: 545959 - DNA, 480 bp, Homo sapiens
  misc_feature: HIJSMM301CPVLJ.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatattttaccctcgttattttcggccctgggaccacagtagatatcaaacaactgtggctgcacc

SEQ ID NO: 545960 - DNA, 485 bp, Homo sapiens; identical to SEQ ID NO: 535606
  misc_feature: HIJSMM301BI9L5.47.46.E02.1.454.light.4.raw

SEQ ID NO: 545961 - DNA, 512 bp, Homo sapiens
  misc_feature: HIJSMM301CHZ99.14.78.H01.1.454.light.4.raw
cgtctagtaccacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 545962 - DNA, 477 bp, Homo sapiens
  misc_feature: HIJSMM301DC6RU.13.39.D06.1.454.light.4.raw
tcacgtactacacgaccggtgctcgatttagtgacatctcgcagttctttgggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtcct

SEQ ID NO: 545963 - DNA, 487 bp, Homo sapiens
  misc_feature: HIJSMM301AWLBY.52.33.C11.1.454.light.4.raw
cgcagtacgacacgaccggtgctcgatttagagtgagctcgttgggtttgggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggcc

SEQ ID NO: 545964 - DNA, 505 bp, Homo sapiens
  misc_feature: HIJSMM301DL7UP.10.12.B01.1.454.light.4.raw
catagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattctctggctccagctcagggacaacagtgacgttgaccatcagcggagcccgggcagaggacgaggctgactattactgtcaatcacaagacattactggtacttattgggtgttcggcggagggtccaagctgaccgtcctaggtcagcccaaggctgccccctcggtcactctgttcccg

SEQ ID NO: 545965 - DNA, 504 bp, Homo sapiens
  misc_feature: HIJSMM301CYXN7.43.35.D02.1.454.light.4.raw
tgtgagtagtcacgaccggtgctcgatttagcacacgatagttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaattcggttcagggaccgaacttagtacaatcaactacgtacgtagtggcgtcgtcaccaactcttcg

SEQ ID NO: 545966 - DNA, 495 bp, Homo sapiens
  misc_feature: HIJSMM301ARCWM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactagtggcg

SEQ ID NO: 545967 - DNA, 447 bp, Homo sapiens; identical to SEQ ID NO: 535201
  misc_feature: HIJSMM301EX7DK.18.9.A09.1.454.light.4.raw

SEQ ID NO: 545968 - DNA, 508 bp, Homo sapiens
  misc_feature: HIJSMM301BIZVL.43.48.E04.1.454.light.4.raw
tgtgagtagtcacgaccggtgctcgatttagagagcgtcacagagagaaggggctgggcctcaggaagcagcatcgggggtgccgcagccatggcctggaccgctctccttctgagcctccttgctcactttacagagtctgtggcctcctacgagctgactcagccaccctcagtgtcagtggccctgggacaggcggccaggataacctgtgggggacacaatattgcagataagagtgtccactggtatcaccagaagcccggccaggcccctgtattggtcatctacagagacaccagccggcccgctgggatccctgagcgattctctgcctccaactcggggaacacggccaccctgaccatcagcagagcccaagtcggggatgagggtgactattactgtcaagtgtgggacaagagcactgtgattttcggcggaggggccaagttgaccgttttaggtcagcccaaggctgccccctcggtcactctgttcccgccct

SEQ ID NO: 545969 - DNA, 495 bp, Homo sapiens; identical to SEQ ID NO: 538920
  misc_feature: HIJSMM301CUUU2.47.64.F09.1.454.light.4.raw

SEQ ID NO: 545970 - DNA, 493 bp, Homo sapiens
  misc_feature: HIJSMM301A4DJ3.41.72.G06.1.454.light.4.raw
tctatactatcacgaccggtgctcgatttagctacgactgcaagggaaaggggctccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagaccccg

SEQ ID NO: 545971 - DNA, 444 bp, Homo sapiens; identical to SEQ ID NO: 535027
  misc_feature: HIJSMM301C6AHZ.8.73.G07.1.454.light.4.raw

SEQ ID NO: 545972 - DNA, 511 bp, Homo sapiens
  misc_feature: HIJSMM301B5K9Y.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgcca

SEQ ID NO: 545973 - DNA, 454 bp, Homo sapiens; identical to SEQ ID NO: 535005
  misc_feature: HIJSMM301ANOXP.19.86.H09.1.454.light.4.raw

SEQ ID NO: 545974 - DNA, 497 bp, Homo sapiens
  misc_feature: HIJSMM301DTX5X.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggttattactgcatgcaaggtctacaaaccccgatcaccttcggccgagggacacgcctggagattaaacgaactgtggctgcaccat

SEQ ID NO: 545975 - DNA, 486 bp, Homo sapiens
  misc_feature: HIJSMM301CC4FH.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcaccatcctgtcttc

SEQ ID NO: 545976 - DNA, 500 bp, Homo sapiens
  misc_feature: HIJSMM301AUPA4.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaatcaaacgaactagtggctgcaccatctgtcttcta

SEQ ID NO: 545977 - DNA, 494 bp, Homo sapiens
  misc_feature: HIJSMM301EIJMG.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaaacgaactgtggctgcaccatctgtcttcatcttcccgccat

SEQ ID NO: 545978 - DNA, 514 bp, Homo sapiens
  misc_feature: HIJSMM301DSA6N.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 545979 - DNA, 373 bp, Homo sapiens
  misc_feature: HIJSMM301B9X3I.21.25.C03.1.454.light.4.raw
tcgtcgctcgcacgaccggtgctcgatttagtagtgtagatttgggtttgggagcagctccaacatcgggtcaccttttgatgtgcactggtatcagcaacttccaggaacagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggtttttggctgttcggcggcgggaccaagctgaccgtcctaggtcagcccaaggctgccccctcggtcactctgttcccaccctcctccgagcgacga

SEQ ID NO: 545980 - DNA, 486 bp, Homo sapiens; identical to SEQ ID NO: 535043
  misc_feature: HIJSMM301A2RV8.46.35.D02.1.454.light.4.raw

SEQ ID NO: 545981 - DNA, 483 bp, Homo sapiens
  misc_feature: HIJSMM301CLEQA.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggcctcaagtctggcacctcagcctccctggtcatcgcgtgggctccgaggctgacgatggaggctgatttattattgccagtcctatgacaaccacctgcgttggttttgctgttcggcggcggac

SEQ ID NO: 545982 - DNA, 505 bp, Homo sapiens; identical to SEQ ID NO: 536117
  misc_feature: HIJSMM301A90UE.8.71.G05.1.454.light.4.raw

SEQ ID NO: 545983 - DNA, 505 bp, Homo sapiens; identical to SEQ ID NO: 541723
  misc_feature: HIJSMM301BA922.5.24.C02.1.454.light.4.raw

SEQ ID NO: 545984 - DNA, 509 bp, Homo sapiens; identical to SEQ ID NO: 537131
  misc_feature: HIJSMM301CC7IC.17.33.C11.1.454.light.4.raw

SEQ ID NO: 545985 - DNA, 511 bp, Homo sapiens
  misc_feature: HIJSMM301BP92O.7.34.D01.1.454.light.4.raw
cgtgtctctacacgaccggtgctcgatttagatcgtctgtgttggggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 545986 - DNA, 492 bp, Homo sapiens
  misc_feature: HIJSMM301APR98.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccaaggtggagatcaacgaactgtggctgcaccatctgtcttcat

SEQ ID NO: 545987 - DNA, 509 bp, Homo sapiens
  misc_feature: HIJSMM301BEF1X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctggccgattcagtggcagcgggtctgggacagatttcactctcaccatcagcagcctgcaggctgaagatgtggcagtttattactgtcaacagttttctcgggcgttcggtccgaacgggaccaaggtggaaagtacaaaacgaactagtggctgcaccatctgtcttcatcttccccg

SEQ ID NO: 545988 - DNA, 474 bp, Homo sapiens; identical to SEQ ID NO: 539713
  misc_feature: HIJSMM301DB8QW.5.28.C06.1.454.light.4.raw

SEQ ID NO: 545989 - DNA, 502 bp, Homo sapiens
  misc_feature: HIJSMM301EWJOK.48.29.C07.1.454.light.4.raw
agtatacatacacgaccggtgctcgatttagagtgctacgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttatttacgtcggaccttggccaaggacgacgactggagattaaacgaactagtggctgcaccatctgtcttcatctttcccgcccta

SEQ ID NO: 545990 - DNA, 499 bp, Homo sapiens
  misc_feature: HIJSMM301AHTTQ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggctgccccctccggtcgactctcg

SEQ ID NO: 545991 - DNA, 478 bp, Homo sapiens
  misc_feature: HIJSMM301APE5E.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaacgcggtggagatcagacgaactgtggctgcaccatctgtctt

SEQ ID NO: 545992 - DNA, 487 bp, Homo sapiens; identical to SEQ ID NO: 541187
  misc_feature: HIJSMM301BT8ZT.43.36.D03.1.454.light.4.raw

SEQ ID NO: 545993 - DNA, 487 bp, Homo sapiens
  misc_feature: HIJSMM301ENI6D.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggagggaccaaggtggaggatcaaacgtaac

SEQ ID NO: 545994 - DNA, 418 bp, Homo sapiens
  misc_feature: HIJSMM301B309Q.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggcccaaccccactgtcactctgttccccaccctcctcgagtagtaca

SEQ ID NO: 545995 - DNA, 485 bp, Homo sapiens
  misc_feature: HIJSMM301ARWG9.48.55.E11.1.454.light.4.raw
agtatacatacacgaccggtgctcgatttagcactcgcacgttgggtttgggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggtccaagggaccaaggtggaagtcaaacgaacctagtggctg

SEQ ID NO: 545996 - DNA, 483 bp, Homo sapiens
  misc_feature: HIJSMM301C681A.49.81.H04.1.454.light.4.raw
agtcgagagacacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactagtggctgcaccat

SEQ ID NO: 545997 - DNA, 506 bp, Homo sapiens
  misc_feature: HIJSMM301DVOJ5.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagccccatgtgatcttcggcggggggaccgaagctgaccgtcctaggtcagcccaaggctgtccccccg

SEQ ID NO: 545998 - DNA, 507 bp, Homo sapiens; identical to SEQ ID NO: 535641
  misc_feature: HIJSMM301DUANB.10.88.H11.1.454.light.4.raw

SEQ ID NO: 545999 - DNA, 477 bp, Homo sapiens
  misc_feature: HIJSMM301AS2AD.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttggtatcaacagaggccaggccacgcccctgtcttaatgatatataaagacagtgagaggccctcagggatctctgagcgattctctgcctccagctcagggacaacattcacatttgaccatcagtgaagtccaggcagaagatgaggctgactattattgtcaatcaacagacagtagtgggaaatatgtggtattcggcggagggaccaaactgaccgtcctaggtcacgcccaaggc

SEQ ID NO: 546000 - DNA, 448 bp, Homo sapiens; identical to SEQ ID NO: 540364
  misc_feature: HIJSMM301EJIFZ.18.9.A09.1.454.light.4.raw

SEQ ID NO: 546001 - DNA, 486 bp, Homo sapiens; identical to SEQ ID NO: 535385
  misc_feature: HIJSMM301B7XLI.19.71.G05.1.454.light.4.raw

SEQ ID NO: 546002 - DNA, 494 bp, Homo sapiens; identical to SEQ ID NO: 535276
  misc_feature: HIJSMM301AMU65.16.6.A06.1.454.light.4.raw

SEQ ID NO: 546003 - DNA, 485 bp, Homo sapiens
  misc_feature: HIJSMM301AFQ6K.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctccggtcactctgttcccaccctcctctacgtgagct

SEQ ID NO: 546004 - DNA, 440 bp, Homo sapiens; identical to SEQ ID NO: 543785
  misc_feature: HIJSMM301EKUO8.4.22.B11.1.454.light.4.raw

SEQ ID NO: 546005 - DNA, 464 bp, Homo sapiens; identical to SEQ ID NO: 539492
  misc_feature: HIJSMM301ENXG2.18.59.F04.1.454.light.4.raw

SEQ ID NO: 546006 - DNA, 482 bp, Homo sapiens
  misc_feature: HIJSMM301AF15Y.5.12.B01.1.454.light.4.raw
atcagacacgcacgaccggtgctcgatttagtagtgtagattccgcgggggcccacctgttagggctcaggggcgtgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaaattctactcacgtttgatttccaccttggtcccttggccgaacgtcctcgggtgttcggcggagggaccaagctgaccgtcctaggtcagcccaaggctgccccctcggtcactctgttcccaccctcctccgtgtctgat

SEQ ID NO: 546007 - DNA, 485 bp, Homo sapiens; identical to SEQ ID NO: 538194
  misc_feature: HIJSMM301BY544.47.62.F07.1.454.light.4.raw

SEQ ID NO: 546008 - DNA, 504 bp, Homo sapiens
  misc_feature: HIJSMM301D5NTO.48.16.B05.1.454.light.4.raw
agtatacatacacgaccggtgctcgatttagagctcacgtaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggcggagggaccaaactgaccgtcctcggtcggcccaaggctgccccctggtcactctcg

SEQ ID NO: 546009 - DNA, 485 bp, Homo sapiens
  misc_feature: HIJSMM301CU7HA.19.71.G05.1.454.light.4.raw
  modified_base (480)..(480): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttgtggacgttcggccaagggaccaaggtggatatcanacgaa

SEQ ID NO: 546010 - DNA, 487 bp, Homo sapiens; identical to SEQ ID NO: 536206
  misc_feature: HIJSMM301EJU4I.47.38.D05.1.454.light.4.raw

SEQ ID NO: 546011 - DNA, 504 bp, Homo sapiens
  misc_feature: HIJSMM301DP537.21.22.B11.1.454.light.4.raw
  modified_base (414)..(414): a, c, t, g, unknown or other
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattacngtgcatcacggggacncaaacatgggatgacaatctgagcggttgggtgttcggcggagggaccaaactgaccgtcctaggtcagcccaa

SEQ ID NO: 546012 - DNA, 504 bp, Homo sapiens
  misc_feature: HIJSMM301D8VE4.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgccagggaccgacacgtagaatagagacgaactagtggctgcaccatctgtcttctatcttcccgt

SEQ ID NO: 546013 - DNA, 486 bp, Homo sapiens; identical to SEQ ID NO: 537617
  misc_feature: HIJSMM301CD0IM.10.53.E09.1.454.light.4.raw

SEQ ID NO: 546014 - DNA, 492 bp, Homo sapiens
  misc_feature: HIJSMM301DS30N.3.31.C09.1.454.light.4.raw
agacgcactccacgaccggtgctcgatttagacgtctcatcaaggaaggaaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttatactgtcagcagcgtagcaactggcctctcactttcggcggagggaccaaggtgagatcaaacgaactgtggctgcaccatctgtctt

SEQ ID NO: 546015 - DNA, 482 bp, Homo sapiens
  misc_feature: HIJSMM301CU7JC.41.68.G02.1.454.light.4.raw
tctatactatcacgaccggtgctcgatttagtcgatagtgaagggaaaggggagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtggctgcaccatctgt

SEQ ID NO: 546016 - DNA, 494 bp, Homo sapiens
  misc_feature: HIJSMM301A8Q41.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatattttctatcctccgtgacgttgcaaggacaggtggaatcagacgaactgtggctgacaccat

SEQ ID NO: 546017 - DNA, 488 bp, Homo sapiens
  misc_feature: HIJSMM301B1EBJ.43.33.C11.1.454.light.4.raw
  modified_base (397)..(397): a, c, t, g, unknown or other
  modified_base (466)..(466): a, c, t, g, unknown or other
tgtgagtagtcacgaccggtgctcgatttagagtgagctcgttgggtttgggcggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttcnctcgtcatcactggtctacagtctgacgacggcgcaatgtacttctgtcaacactatgcctctcccccnctaatgttcgagacggactagt

SEQ ID NO: 546018 - DNA, 494 bp, Homo sapiens; identical to SEQ ID NO: 534992
  misc_feature: HIJSMM301BJPIK.9.1.A01.1.454.light.4.raw

SEQ ID NO: 546019 - DNA, 480 bp, Homo sapiens; identical to SEQ ID NO: 535291
  misc_feature: HIJSMM301A784L.22.59.F04.1.454.light.4.raw

SEQ ID NO: 546020 - DNA, 457 bp, Homo sapiens; identical to SEQ ID NO: 536586
  misc_feature: HIJSMM301AHEI0.49.85.H08.1.454.light.4.raw

SEQ ID NO: 546021 - DNA, 487 bp, Homo sapiens; identical to SEQ ID NO: 537208
  misc_feature: HIJSMM301DDI6N.3.55.E11.1.454.light.4.raw

SEQ ID NO: 546022 - DNA, 495 bp, Homo sapiens; identical to SEQ ID NO: 536055
  misc_feature: HIJSMM301DD8KU.47.38.D05.1.454.light.4.raw

SEQ ID NO: 546023 - DNA, 503 bp, Homo sapiens
  misc_feature: HIJSMM301BQ30N.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccagggggaccaaggtggagatcagacgaactgtggctgcaccatctgtcttcatcttccccg

SEQ ID NO: 546024 - DNA, 487 bp, Homo sapiens; identical to SEQ ID NO: 536206
  misc_feature: HIJSMM301A2TLG.47.38.D05.1.454.light.4.raw

SEQ ID NO: 546025 - DNA, 410 bp, Homo sapiens
  misc_feature: HIJSMM301DJ72H.10.86.H09.1.454.light.4.raw
catagtagtgcacgaccggtgctcgatttagtgctatagacttgggtttgggaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccgccctcctccactactatg

SEQ ID NO: 546026 - DNA, 479 bp, Homo sapiens; identical to SEQ ID NO: 535118
  misc_feature: HIJSMM301B24GW.13.59.F04.1.454.light.4.raw

SEQ ID NO: 546027 - DNA, 494 bp, Homo sapiens; identical to SEQ ID NO: 534992
  misc_feature: HIJSMM301BIN8T.9.1.A01.1.454.light.4.raw

SEQ ID NO: 546028 - DNA, 486 bp, Homo sapiens; identical to SEQ ID NO: 535385
  misc_feature: HIJSMM301DVTLN.19.71.G05.1.454.light.4.raw

SEQ ID NO: 546029 - DNA, 486 bp, Homo sapiens; identical to SEQ ID NO: 536323
  misc_feature: HIJSMM301AYR50.10.2.A02.1.454.light.4.raw

SEQ ID NO: 546030 - DNA, 496 bp, Homo sapiens
  misc_feature: HIJSMM301DISW8.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccttcagtggagtccaggcagaggacgaggctgactaccactgtcaatcaacagacagcagtggttcttatgtcttcgcaactgggaccaaggtcaccgtcctaggtcagcccaaggccaaccccactgtcactctcg

SEQ ID NO: 546031 - DNA, 503 bp, Homo sapiens
  misc_feature: HIJSMM301A30I7.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 546032 - DNA, 486 bp, Homo sapiens; identical to SEQ ID NO: 537428
  misc_feature: HIJSMM301C52HX.47.62.F07.1.454.light.4.raw

SEQ ID NO: 546033 - DNA, 486 bp, Homo sapiens
  misc_feature: HIJSMM301B3KW4.17.39.D06.1.454.light.4.raw
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgtggctgca

SEQ ID NO: 546034 - DNA, 504 bp, Homo sapiens
  misc_feature: HIJSMM301ARQ2C.40.60.F05.1.454.light.4.raw
tctagcgactcacgaccggtgctcgatttagtacgtcatcagggaaagggggagctgctcagttaggacccagagggaaccatggaaaccccagcgcagcttctcttcctcctgctactctggctcccagagacccccggagaaattgtgttgacgcagtctccaggcaccctgtctttgtctccaggggaaagagccaccctctcctgcagggccagtcagagtgtaaccaacaactacttaatgtggtaccagcaaaaacctaggccaggctcccaggctcctcatctatggtgcatccaacagggccagtggcatcccagacaggtttagaggcagtggggccgacacagacttcactctcaccatcagcagactggagcctgaagattttgcactgtattactgtcaccagtctgctcacgtacctctcactttcggcggagggaccaaggtggagatcaaacgaactgtggctgcaccatctgtcttcatcttcccgcc

SEQ ID NO: 546035 - DNA, 512 bp, Homo sapiens
  misc_feature: HIJSMM301CZUA6.22.36.D03.1.454.light.4.raw
acatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattagcgccactctcgtggttttcggcggaggcaccgaagtgaccgtcctcggtcagcccaaggctgccccctcggtcactt

SEQ ID NO: 546036 - DNA, 487 bp, Homo sapiens
  misc_feature: HIJSMM301EIVIS.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccccg

SEQ ID NO: 546037 - DNA, 501 bp, Homo sapiens
  misc_feature: HIJSMM301BE4O4.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcagagggaccaaggtggagatcaaacgaactgtggctgcaccat

SEQ ID NO: 546038 - DNA, 447 bp, Homo sapiens; identical to SEQ ID NO: 535020
  misc_feature: HIJSMM301DU8PU.18.9.A09.1.454.light.4.raw

SEQ ID NO: 546039 - DNA, 519 bp, Homo sapiens; identical to SEQ ID NO: 540265
  misc_feature: HIJSMM301EVN00.22.30.C08.1.454.light.4.raw

SEQ ID NO: 546040 - DNA, 489 bp, Homo sapiens
  misc_feature: HIJSMM301DYEAL.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcggcggagggaccagtctgaccgtcttaggtcagcccaaggctgccccctcggtcact

SEQ ID NO: 546041 - DNA, 444 bp, Homo sapiens; identical to SEQ ID NO: 534993
  misc_feature: HIJSMM301EK8RE.5.9.A09.1.454.light.4.raw

SEQ ID NO: 546042 - DNA, 486 bp, Homo sapiens
  misc_feature: HIJSMM301EFUEH.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgcttttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtcta

SEQ ID NO: 546043 - DNA, 488 bp, Homo sapiens
  misc_feature: HIJSMM301AONTM.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgcaccatctgt

SEQ ID NO: 546044 - DNA, 493 bp, Homo sapiens
  misc_feature: HIJSMM301B6LH4.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaacccactgtcactcttcg

SEQ ID NO: 546045 - DNA, 514 bp, Homo sapiens; identical to SEQ ID NO: 540552
  misc_feature: HIJSMM301DUA6K.16.66.F11.1.454.light.4.raw

SEQ ID NO: 546046 - DNA, 495 bp, Homo sapiens; identical to SEQ ID NO: 535821
  misc_feature: HIJSMM301ARAF5.3.31.C09.1.454.light.4.raw

SEQ ID NO: 546047 - DNA, 463 bp, Homo sapiens; identical to SEQ ID NO: 535008
  misc_feature: HIJSMM301EHVCW.10.9.A09.1.454.light.4.raw

SEQ ID NO: 546048 - DNA, 520 bp, Homo sapiens
  misc_feature: HIJSMM301C1VAZ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccaccct

SEQ ID NO: 546049 - DNA, 494 bp, Homo sapiens; identical to SEQ ID NO: 534992
  misc_feature: HIJSMM301CKH7V.9.1.A01.1.454.light.4.raw

SEQ ID NO: 546050 - DNA, 533 bp, Homo sapiens
  misc_feature: HIJSMM301APWJX.48.14.B03.1.454.light.4.raw
agtatacatacacgaccggtgctcgatttagtgtgagtagttccgcgggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagttaaaaatggaaacatttacttacattggtttcaacagaggccaggccagtctccaaggcgcctgatttatgacgtttttaaacgggagtctggggtcccagacagattcagcggtcagtgggtcagacactgacttcacactgagaatcagcagggttgaggctgaggatgttggcactttattactgcatgcaaggctcacactggcctcccgtggacgttcggtccgaagggacccggggtcggaaaagtaaaacgaaaccgtagttggcgtgcaccaactctggtctttccta

SEQ ID NO: 546051 - DNA, 478 bp, Homo sapiens; identical to SEQ ID NO: 543315
  misc_feature: HIJSMM301AFWVI.26.72.G06.1.454.light.4.raw

SEQ ID NO: 546052 - DNA, 507 bp, Homo sapiens
  misc_feature: HIJSMM301B21NF.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactattgtcaacaggctgccggtttcccttggacgttcggccaagggaccaaggtggaaagtcaaacgaaactgtggctgcaccatctgtcttcatcttcccgccat

SEQ ID NO: 546053 - DNA, 521 bp, Homo sapiens
  misc_feature: HIJSMM301DOX0F.41.87.H10.1.454.light.4.raw
tctatactatcacgaccggtgctcgatttagcagtactgcgttgggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttcccta

SEQ ID NO: 546054 - DNA, 447 bp, Homo sapiens; identical to SEQ ID NO: 535201
  misc_feature: HIJSMM301AD3CO.18.9.A09.1.454.light.4.raw

SEQ ID NO: 546055 - DNA, 501 bp, Homo sapiens
  misc_feature: HIJSMM301CZN61.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcgcggaggtgccactttcggcggagggaccaaatagaggtcaaacgaactgtggctgcaccatctgtcttcatt

SEQ ID NO: 546056 - DNA, 498 bp, Homo sapiens
  misc_feature: HIJSMM301C019J.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggtattttgcagttgtattactgtcagcagtatcataggtacaaacaccttcggccgaagggacacgactggagattaaaggaactgtggctgcacatctgtcttcatcttccccg

SEQ ID NO: 546057 - DNA, 502 bp, Homo sapiens
  misc_feature: HIJSMM301DXO78.21.22.B11.1.454.light.4.raw
  modified_base (329)..(329): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccggcagagggtcaccatctcttgttctggaggcaactccaacatcggaagtaattatgtattctggtatcagcaactcccaggaatggcccccaaacctctcatccagaggaataatcagcggccctcaggggtccctnaccgattctctggctccaagtctggcacctcagcctccctgaccatcagtgggctccggtccgaggatgaggctgactattactgtgcaatcacgggacgcaacatgggatgacaatctgagcggttgggtgttcggcggagggaccaaactgaccgtcctaggtcagcccaa

SEQ ID NO: 546058 - DNA, 506 bp, Homo sapiens; identical to SEQ ID NO: 540486
  misc_feature: HIJSMM301CNM4V.8.33.C11.1.454.light.4.raw

SEQ ID NO: 546059 - DNA, 375 bp, Homo sapiens; identical to SEQ ID NO: 537938
  misc_feature: HIJSMM301ED1PU.9.11.A11.1.454.light.4.raw

SEQ ID NO: 546060 - DNA, 502 bp, Homo sapiens
  misc_feature: HIJSMM301EEK7J.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagcaatatttttctatcctccgtggacgttcggccaagggaccagggtggaaatcagacgaactgtggctgcaccat

SEQ ID NO: 546061 - DNA, 494 bp, Homo sapiens; identical to SEQ ID NO: 542031
  misc_feature: HIJSMM301BTYLQ.12.23.C01.1.454.light.4.raw

SEQ ID NO: 546062 - DNA, 511 bp, Homo sapiens
  misc_feature: HIJSMM301EC6OH.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 546063 - DNA, 419 bp, Homo sapiens
  misc_feature: HIJSMM301BQTTQ.41.53.E09.1.454.light.4.raw
  modified_base (401)..(401): a, c, t, g, unknown or other
tctatactatcacgaccggtgctcgatttagagagagtgtgttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctcggtcactctgttcccnccctcctcatagtataga

SEQ ID NO: 546064 - DNA, 487 bp, Homo sapiens
  misc_feature: HIJSMM301B8CI1.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggaggaccaaggttgagatcaaacgaactgtggctgcacca

SEQ ID NO: 546065 - DNA, 495 bp, Homo sapiens
  misc_feature: HIJSMM301CY9BK.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggttatcagcagaagtcaggccaggccccaagactgctcatgtatagagacagtgagaggtcctcagggatccctgagcgattctctggctccagctctgggacgacactcactctgactatcagtgaagtccgggcgagaagacgaggctgactactattgtcagtcaggagacaatactcgcacgcaagtactgttcggcggagggaccaagctgacagtcctaggtcagcccaaggctgtccccccg

SEQ ID NO: 546066 - DNA, 492 bp, Homo sapiens
  misc_feature: HIJSMM301BML5B.51.27.C05.1.454.light.4.raw
cgatcgtatacacgaccggtgctcgatttagacgcgatcgaagggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgcccctcggtcact

SEQ ID NO: 546067 - DNA, 492 bp, Homo sapiens
  misc_feature: HIJSMM301BPWW1.43.77.G11.1.454.light.4.raw
tgtgagtagtcacgaccggtgctcgatttagctagtcactcaaggggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtcct

SEQ ID NO: 546068 - DNA, 487 bp, Homo sapiens; identical to SEQ ID NO: 541583
  misc_feature: HIJSMM301CY8N9.41.57.F02.1.454.light.4.raw

SEQ ID NO: 546069 - DNA, 490 bp, Homo sapiens; identical to SEQ ID NO: 541567
  misc_feature: HIJSMM301BBPTK.22.65.F10.1.454.light.4.raw

SEQ ID NO: 546070 - DNA, 492 bp, Homo sapiens; identical to SEQ ID NO: 539630
  misc_feature: HIJSMM301DZTP3.22.25.C03.1.454.light.4.raw

SEQ ID NO: 546071 - DNA, 501 bp, Homo sapiens
  misc_feature: HIJSMM301BS3B5.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggctccctgaccgtctctgggctccaggctgaggatgaggctgattattattgcagctcatatgcaggcagttacaatgtgatattcggcggagggaccaaactgaccgtcctaggtcagccaaggctgccccctc

SEQ ID NO: 546072 - DNA, 506 bp, Homo sapiens
  misc_feature: HIJSMM301BF5WO.40.41.D08.1.454.light.4.raw
tctagcgactcacgaccggtgctcgatttagtcacgcgagaaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactccccatgtggtattcggcggagggaccaagctgaccgtcctaggtcagcccaaggctgccccccg

SEQ ID NO: 546073 - DNA, 391 bp, Homo sapiens
  misc_feature: HIJSMM301BFSOZ.21.40.D07.1.454.light.4.raw
tcgtcgctcgcacgaccggtgctcgatttagtgatagagcgtaacaacagagggtcaccatcccttgttctggaagcagctccaacatcggaagacattatgtgtactggtaccagcagctcccaggaacggcccccaaactcctcatctataggaataatcagcggccctcaggggtcccgtcgaccgattctctggctccaattctggcacctcagcctccctggccatcagtgggctccggtccgaggatgaggctgattattactgtgcagcatgtgatgacggcctgagtggtccggtgttcggcggagggaccaggctgaccgtcctaggtcagcccaaggctgccccctcggtcactctgttcccaccctcctccgagcgacga

SEQ ID NO: 546074 - DNA, 473 bp, Homo sapiens; identical to SEQ ID NO: 538711
  misc_feature: HIJSMM301CNUQG.11.17.B06.1.454.light.4.raw

SEQ ID NO: 546075 - DNA, 503 bp, Homo sapiens
  misc_feature: HIJSMM301AN1Z0.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtggctgcaccatctgt

SEQ ID NO: 546076 - DNA, 494 bp, Homo sapiens; identical to SEQ ID NO: 535680
  misc_feature: HIJSMM301CAC5H.16.78.H01.1.454.light.4.raw

SEQ ID NO: 546077 - DNA, 516 bp, Homo sapiens
  misc_feature: HIJSMM301AEL2F.17.33.C11.1.454.light.4.raw
  modified_base (507)..(507): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccnccctcctcc

SEQ ID NO: 546078 - DNA, 515 bp, Homo sapiens
  misc_feature: HIJSMM301BGBTD.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccgaacgggaccgaaggtaggaaagtacaaacgaactagtggcgtgcaccatctcgtcttctatcttccccg

SEQ ID NO: 546079 - DNA, 493 bp, Homo sapiens
  misc_feature: HIJSMM301D81Q1.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacactttggccaggggacccaggtggagatcagacgaactgtggctgcaccatctgtcttcatcttcccg

SEQ ID NO: 546080 - DNA, 500 bp, Homo sapiens
  misc_feature: HIJSMM301DOPHM.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccagggtggaaatacaagcggaactgtggctgcaccatctgtcttcta

SEQ ID NO: 546081 - DNA, 495 bp, Homo sapiens
  misc_feature: HIJSMM301BBLQJ.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggtcg

SEQ ID NO: 546082 - DNA, 473 bp, Homo sapiens; identical to SEQ ID NO: 536937
  misc_feature: HIJSMM301A69HW.13.76.G10.1.454.light.4.raw

SEQ ID NO: 546083 - DNA, 445 bp, Homo sapiens
  misc_feature: HIJSMM301ETI6T.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccgccctcctccgtgtctgat

SEQ ID NO: 546084 - DNA, 517 bp, Homo sapiens
  misc_feature: HIJSMM301CI41C.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccaccctcct

SEQ ID NO: 546085 - DNA, 497 bp, Homo sapiens; identical to SEQ ID NO: 536376
  misc_feature: HIJSMM301CDQ8Q.22.9.A09.1.454.light.4.raw

SEQ ID NO: 546086 - DNA, 494 bp, Homo sapiens; identical to SEQ ID NO: 539894
  misc_feature: HIJSMM301AVQNJ.16.53.E09.1.454.light.4.raw

SEQ ID NO: 546087 - DNA, 457 bp, Homo sapiens; identical to SEQ ID NO: 536586
  misc_feature: HIJSMM301AYRCR.49.85.H08.1.454.light.4.raw

SEQ ID NO: 546088 - DNA, 476 bp, Homo sapiens
  misc_feature: HIJSMM301A8QJN.13.71.G05.1.454.light.4.raw
tcacgtactacacgaccggtgctcgatttagtgtcgtcgcaagagagaggggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaccgtcctaggtcagcccaaggccaa

SEQ ID NO: 546089 - DNA, 492 bp, Homo sapiens; identical to SEQ ID NO: 537666
  misc_feature: HIJSMM301D02TX.43.33.C11.1.454.light.4.raw

SEQ ID NO: 546090 - DNA, 495 bp, Homo sapiens
  misc_feature: HIJSMM301BZHK6.22.27.C05.1.454.light.4.raw
acatacgcgtcacgaccggtgctcgatttagacgcgatcgaagggtttggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgaactgtggctgcacc

SEQ ID NO: 546091 - DNA, 507 bp, Homo sapiens
  misc_feature: HIJSMM301A70W8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaatacaaacgaactagtggctgcaccatctgtcttctatcttccccg

SEQ ID NO: 546092 - DNA, 490 bp, Homo sapiens; identical to SEQ ID NO: 535420
  misc_feature: HIJSMM301C1OP6.3.72.G06.1.454.light.4.raw

SEQ ID NO: 546093 - DNA, 517 bp, Homo sapiens
  misc_feature: HIJSMM301AGC9Y.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctcgccccctcggtcactctcgttcccaccctcctcg

SEQ ID NO: 546094 - DNA, 479 bp, Homo sapiens
  misc_feature: HIJSMM301BVGTY.12.19.B08.1.454.light.4.raw
atacgacgtacacgaccggtgctcgatttagtgagtcagtaaggggcctgaagacttttttatgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatctgtgggagacagagtcaccatcacttgccgggcaagtcagaggattagcagttatttaaattggtgtcagcagaagccagggagagcccctaaggtcctgatctatgcttcatccagtttgcaaagtgggtcccatcaaggttcagtggcagtggatctgggacagatttcactctcaccatcagcggtctgcaacctgaagattttgcaacttacttctgtcaacagagttacaatacccctccgtcacctgcggccaagggacacgg

SEQ ID NO: 546095 - DNA, 500 bp, Homo sapiens
  misc_feature: HIJSMM301AJCWE.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcactc

SEQ ID NO: 546096 - DNA, 490 bp, Homo sapiens
  misc_feature: HIJSMM301CQAX5.52.85.H08.1.454.light.4.raw
cgcagtacgacacgaccggtgctcgatttagtatcactcagtcgcgggggcctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctggt

SEQ ID NO: 546097 - DNA, 492 bp, Homo sapiens; identical to SEQ ID NO: 536010
  misc_feature: HIJSMM301BCQ4K.10.20.B09.1.454.light.4.raw

SEQ ID NO: 546098 - DNA, 489 bp, Homo sapiens
  misc_feature: HIJSMM301BMR63.4.57.F02.1.454.light.4.raw
agcactgtagcacgaccggtgctcgatttagctcgatatagttgggtttgggggcaggagccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgtaacttactactgtcaacagagttacgatacccctccgctcactttcggcggagggaccaaggtggagatcaaacgaactgtggctgcacca

SEQ ID NO: 546099 - DNA, 481 bp, Homo sapiens
  misc_feature: HIJSMM301E0K1J.21.25.C03.1.454.light.4.raw
  modified_base (120)..(120): a, c, t, g, unknown or other
tcgtcgctcgcacgaccggtgctcgatttagtagtgtagatttgggtttggggctgttcctggaagttgctgataccagtgcacatcaaaaggtgacccgatgttggagctgctcccagngcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggcgggaccc

SEQ ID NO: 546100 - DNA, 504 bp, Homo sapiens; identical to SEQ ID NO: 537401
  misc_feature: HIJSMM301AI6T0.51.23.C01.1.454.light.4.raw

SEQ ID NO: 546101 - DNA, 495 bp, Homo sapiens
  misc_feature: HIJSMM301B33AZ.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctgaccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatcttcccgcc

SEQ ID NO: 546102 - DNA, 464 bp, Homo sapiens
  misc_feature: HIJSMM301AH8KW.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccgaaggtggagatcaaacgaaa

SEQ ID NO: 546103 - DNA, 481 bp, Homo sapiens; identical to SEQ ID NO: 535061
  misc_feature: HIJSMM301EPXGQ.16.81.H04.1.454.light.4.raw

SEQ ID NO: 546104 - DNA, 497 bp, Homo sapiens; identical to SEQ ID NO: 535664
  misc_feature: HIJSMM301EA0AU.22.14.B03.1.454.light.4.raw

SEQ ID NO: 546105 - DNA, 510 bp, Homo sapiens
  misc_feature: HIJSMM301ALL8N.9.37.D04.1.454.light.4.raw
tgatacgtctcacgaccggtgctcgatttagtagcatactgttgggtttgggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccaccctcctcagacgtatca

SEQ ID NO: 546106 - DNA, 505 bp, Homo sapiens
  misc_feature: HIJSMM301AEDMT.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggtcggagggaccaagctgaccgtcctgggtcagcccaaggctgccccctcggtcta

SEQ ID NO: 546107 - DNA, 504 bp, Homo sapiens; identical to SEQ ID NO: 535935
  misc_feature: HIJSMM301ESSTZ.18.78.H01.1.454.light.4.raw

SEQ ID NO: 546108 - DNA, 493 bp, Homo sapiens; identical to SEQ ID NO: 537281
  misc_feature: HIJSMM301D4LRZ.9.1.A01.1.454.light.4.raw

SEQ ID NO: 546109 - DNA, 462 bp, Homo sapiens
  misc_feature: HIJSMM301C7PS5.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagtgctgccccgctcagtttcggcggagggaccaaggtggag

SEQ ID NO: 546110 - DNA, 487 bp, Homo sapiens
  misc_feature: HIJSMM301DH09Z.41.22.B11.1.454.light.4.raw
tctatactatcacgaccggtgctcgatttagacgacagctcaggggagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaagggaccagggtggaaatcaagcgaactgtggctgcaccatctgtctt

SEQ ID NO: 546111 - DNA, 478 bp, Homo sapiens
  misc_feature: HIJSMM301ESK4I.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcggccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaac

SEQ ID NO: 546112 - DNA, 490 bp, Homo sapiens
  misc_feature: HIJSMM301B2LC7.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactagaaaatcagccgggtgggggctgaggatgttggcatttattactgcatgcaggctatacaccttcctgccacttttggccgaggggaccaagctggagatcaggcgaacg

SEQ ID NO: 546113 - DNA, 506 bp, Homo sapiens; identical to SEQ ID NO: 535058
  misc_feature: HIJSMM301EGE68.17.41.D08.1.454.light.4.raw

SEQ ID NO: 546114 - DNA, 383 bp, Homo sapiens; identical to SEQ ID NO: 447524
  misc_feature: HIJSMM301BQYYH.41.26.C04.1.454.light.4.raw

SEQ ID NO: 546115 - DNA, 444 bp, Homo sapiens
  misc_feature: HIJSMM301EIMK4.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcgctggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 546116 - DNA, 482 bp, Homo sapiens
  misc_feature: HIJSMM301CAR46.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgagactgtgcaacttactactgccaacagtcttacggaacctcgtacacttttggccaggggaccaggctggagatcaaacgaactgtggctgcaccatctgtt

SEQ ID NO: 546117 - DNA, 494 bp, Homo sapiens
  misc_feature: HIJSMM301DCMSN.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtctaggtcagcccaaggccaacccc

SEQ ID NO: 546118 - DNA, 506 bp, Homo sapiens; identical to SEQ ID NO: 542696
  misc_feature: HIJSMM301AEH5E.7.71.G05.1.454.light.4.raw

SEQ ID NO: 546119 - DNA, 464 bp, Homo sapiens; identical to SEQ ID NO: 536640
  misc_feature: HIJSMM301BZAG3.26.78.H01.1.454.light.4.raw

SEQ ID NO: 546120 - DNA, 487 bp, Homo sapiens
  misc_feature: HIJSMM301DWWFX.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacatcaatcgaactgtggctgcaccat

SEQ ID NO: 546121 - DNA, 486 bp, Homo sapiens
  misc_feature: HIJSMM301BYJQQ.40.83.H06.1.454.light.4.raw
tctagcgactcacgaccggtgctcgatttagatcacgtgcgtcgcggggtctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcacgg

SEQ ID NO: 546122 - DNA, 494 bp, Homo sapiens; identical to SEQ ID NO: 542031
  misc_feature: HIJSMM301ADWFC.12.23.C01.1.454.light.4.raw

SEQ ID NO: 546123 - DNA, 486 bp, Homo sapiens; identical to SEQ ID NO: 535043
  misc_feature: HIJSMM301APA5L.46.35.D02.1.454.light.4.raw

SEQ ID NO: 546124 - DNA, 486 bp, Homo sapiens; identical to SEQ ID NO: 537617
  misc_feature: HIJSMM301CBPDR.10.53.E09.1.454.light.4.raw

SEQ ID NO: 546125 - DNA, 498 bp, Homo sapiens
  misc_feature: HIJSMM301A4W7A.9.1.A01.1.454.light.4.raw
tgatacgtctcacgaccggtgctcgatttagacgtctcatcagggggagctgcccagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcattttcccgtccca

SEQ ID NO: 546126 - DNA, 521 bp, Homo sapiens
  misc_feature: HIJSMM301DNDYM.49.9.A09.1.454.light.4.raw
agtcgagagacacgaccggtgctcgatttagcgagacgcgcaggggctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcttccgggggtgttcggcggagggaccaagttgaccgtcgttggtcagcccaaggctgccccctggtcactctgttcccaccctcctctctctcga

SEQ ID NO: 546127 - DNA, 502 bp, Homo sapiens
  misc_feature: HIJSMM301EIQEX.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcgagggaccaagctgaccgtctaggtcagcccaaggctgccccctcggtcta

SEQ ID NO: 546128 - DNA, 499 bp, Homo sapiens
  misc_feature: HIJSMM301BB2NB.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagccctggtaccaacagaaacctggccaggctcccaggctcctcatctatgatgcatccaaaagggccactggcatcccagccaggttcagtggcagtgggtctggggcagacttcactctcaccatcagcagcctagagcctgaagatttgcagtttattactgtcagcagcgtagcaactggcctcggttcacttttggccaggggaccaagctggagatcaaacgaactgtggctgcaccatctgtcttcatt

SEQ ID NO: 546129 - DNA, 482 bp, Homo sapiens; identical to SEQ ID NO: 535920
  misc_feature: HIJSMM301EZTFJ.19.71.G05.1.454.light.4.raw

SEQ ID NO: 546130 - DNA, 495 bp, Homo sapiens
  misc_feature: HIJSMM301CAGP0.48.35.D02.1.454.light.4.raw
agtatacatacacgaccggtgctcgatttagcacacgatagttgggtttggggccaaaggatgggaggggtcaggctggaactgaggagcaggtgggggcacttctccctctaacactctccccgctcagctcctgggctcctgctgctctggctcccaggtgccagatgtgccatccagatgacccagtctccatcctcctgtctgcatctgtaggagacagagtcaccttcacttgccggcaagtcaggacattaaagtgatttagcctggtatcagcagaaaccagggagagccctaagctcctcatctatgctgcttccattttacaaagtgagtctcatcaaggttcagcggcggtggatctggcacagatttcactctcaccatcagcagcctgcagcctgaagattttgcaacttattactgtctgcacgattacaattaccctcggacgttcgccgaacggaccgaaggtgaaggtcaacgtaaacg

SEQ ID NO: 546131 - DNA, 493 bp, Homo sapiens
  misc_feature: HIJSMM301BBHAG.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaacgaactgtggctgcaccatctgtcttcat

SEQ ID NO: 546132 - DNA, 488 bp, Homo sapiens; identical to SEQ ID NO: 535861
  misc_feature: HIJSMM301AT8II.14.55.E11.1.454.light.4.raw

SEQ ID NO: 546133 - DNA, 499 bp, Homo sapiens; identical to SEQ ID NO: 537800
  misc_feature: HIJSMM301CVUSQ.22.38.D05.1.454.light.4.raw

SEQ ID NO: 546134 - DNA, 508 bp, Homo sapiens
  misc_feature: HIJSMM301EZ4Q7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaagtacaaacgaactagtggcgtgcaccatctgtcttctatcttccccg

SEQ ID NO: 546135 - DNA, 504 bp, Homo sapiens; identical to SEQ ID NO: 540089
  misc_feature: HIJSMM301E07YO.3.53.E09.1.454.light.4.raw

SEQ ID NO: 546136 - DNA, 494 bp, Homo sapiens; identical to SEQ ID NO: 534994
  misc_feature: HIJSMM301BVVWP.27.78.H01.1.454.light.4.raw

SEQ ID NO: 546137 - DNA, 443 bp, Homo sapiens
  misc_feature: HIJSMM301B21SD.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgcctcctcagacgtatca

SEQ ID NO: 546138 - DNA, 511 bp, Homo sapiens
  misc_feature: HIJSMM301BMR67.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaactagtggctgcaccatctgtcttcatcttcccg

SEQ ID NO: 546139 - DNA, 513 bp, Homo sapiens; identical to SEQ ID NO: 535244
  misc_feature: HIJSMM301BCWA5.17.33.C11.1.454.light.4.raw

SEQ ID NO: 546140 - DNA, 492 bp, Homo sapiens
  misc_feature: HIJSMM301EPU1P.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccagggtggacatcaagcgaactgtggctgcaccatctgtcttcatcttcccgccat

SEQ ID NO: 546141 - DNA, 486 bp, Homo sapiens; identical to SEQ ID NO: 535043
  misc_feature: HIJSMM301CP6OY.46.35.D02.1.454.light.4.raw

SEQ ID NO: 546142 - DNA, 497 bp, Homo sapiens
  misc_feature: HIJSMM301CQMSG.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacacttttggtccagggggactaagctggagatcaaacgaactgtggctgcaccatctgtcttcatcttccccg

SEQ ID NO: 546143 - DNA, 485 bp, Homo sapiens
  misc_feature: HIJSMM301CA45T.52.57.F02.1.454.light.4.raw
cgcagtacgacacgaccggtgctcgatttagctcgatatagttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtt

SEQ ID NO: 546144 - DNA, 463 bp, Homo sapiens; identical to SEQ ID NO: 535062
  misc_feature: HIJSMM301DVZTN.11.73.G07.1.454.light.4.raw

SEQ ID NO: 546145 - DNA, 487 bp, Homo sapiens
  misc_feature: HIJSMM301BLMU8.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttactctcaccatcagtagtctacagcctgaagatattgctacttattactgtcagcagagttaccgcgctcccatcactttcggccaagggacacgaccgcagattggacgaactgtggctgcacc

SEQ ID NO: 546146 - DNA, 495 bp, Homo sapiens
  misc_feature: HIJSMM301A5SQ6.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctggggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 546147 - DNA, 440 bp, Homo sapiens; identical to SEQ ID NO: 537271
  misc_feature: HIJSMM301EUPCH.41.9.A09.1.454.light.4.raw

SEQ ID NO: 546148 - DNA, 481 bp, Homo sapiens; identical to SEQ ID NO: 535993
  misc_feature: HIJSMM301AF7MW.21.25.C03.1.454.light.4.raw

SEQ ID NO: 546149 - DNA, 486 bp, Homo sapiens
  misc_feature: HIJSMM301C44NF.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgaccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 546150 - DNA, 486 bp, Homo sapiens; identical to SEQ ID NO: 535458
  misc_feature: HIJSMM301BPTTJ.7.75.G09.1.454.light.4.raw

SEQ ID NO: 546151 - DNA, 492 bp, Homo sapiens
  misc_feature: HIJSMM301BD5QM.48.75.G09.1.454.light.4.raw
agtatacatacacgaccggtgctcgatttagtatagacatcagggcacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccg

SEQ ID NO: 546152 - DNA, 510 bp, Homo sapiens
  misc_feature: HIJSMM301CT8UI.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggaccgggtggaataaaacgaaactgtggctgcaccatctgtcttcta

SEQ ID NO: 546153 - DNA, 478 bp, Homo sapiens; identical to SEQ ID NO: 535129
  misc_feature: HIJSMM301EB75V.11.11.A11.1.454.light.4.raw

SEQ ID NO: 546154 - DNA, 493 bp, Homo sapiens; identical to SEQ ID NO: 536296
  misc_feature: HIJSMM301BZXJM.5.48.E04.1.454.light.4.raw

SEQ ID NO: 546155 - DNA, 503 bp, Homo sapiens
  misc_feature: HIJSMM301BUOPP.48.30.C08.1.454.light.4.raw
agtatacatacacgaccggtgctcgatttagtctgacgtcaaagggaaagggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccaacgtggaaatcaaacgaactgtggctgcaccatct

SEQ ID NO: 546156 - DNA, 375 bp, Homo sapiens; identical to SEQ ID NO: 537938
  misc_feature: HIJSMM301AJ113.9.11.A11.1.454.light.4.raw

SEQ ID NO: 546157 - DNA, 475 bp, Homo sapiens; identical to SEQ ID NO: 537380
  misc_feature: HIJSMM301AVVT4.5.28.C06.1.454.light.4.raw

SEQ ID NO: 546158 - DNA, 493 bp, Homo sapiens; identical to SEQ ID NO: 543505
  misc_feature: HIJSMM301AIOCA.10.77.G11.1.454.light.4.raw

SEQ ID NO: 546159 - DNA, 494 bp, Homo sapiens; identical to SEQ ID NO: 534994
  misc_feature: HIJSMM301DA62H.27.78.H01.1.454.light.4.raw

SEQ ID NO: 546160 - DNA, 448 bp, Homo sapiens
  misc_feature: HIJSMM301B7TGR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccactactcgta

SEQ ID NO: 546161 - DNA, 490 bp, Homo sapiens
  misc_feature: HIJSMM301C1UYJ.48.53.E09.1.454.light.4.raw
agtatacatacacgaccggtgctcgatttagagagagtgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 546162 - DNA, 496 bp, Homo sapiens
  misc_feature: HIJSMM301DL7XB.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 546163 - DNA, 445 bp, Homo sapiens
  misc_feature: HIJSMM301CKNL4.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctcgttcccgccctcctcagacgtatca

SEQ ID NO: 546164 - DNA, 487 bp, Homo sapiens
  misc_feature: HIJSMM301DPXLF.5.6.A06.1.454.light.4.raw
atcagacacgcacgaccggtgctcgatttagatctactgacagggggagtcagacccagtcaggacacagcatggacatgagggtccccgctcagctcctggggctcctgctgctctggttcccaggttccagatgcgacatccagatgacccagtctccatcttccgtgtctgcttctataggagacagagtcaccatcacttgtcgggcgagtcagggtcttaacaactacttagcctggtatcagcagaagccagggaaagcccctaagctcctgatctatgctacatccagtttgcaaagtggggtcccttcaaggttcagcggcagtggaactggtatagatttcactctcaccatcaccagcctgcagcctgaagatcttgcaacttactattgtcagcaggctaggaggacgccgtggacgttcggccaagggaccaaggtggaaatcaaacgaactgtggctgcaccatctgtcttcta

SEQ ID NO: 546165 - DNA, 478 bp, Homo sapiens
  misc_feature: HIJSMM301CLB9H.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaaagtatagtct

SEQ ID NO: 546166 - DNA, 466 bp, Homo sapiens; identical to SEQ ID NO: 535366
  misc_feature: HIJSMM301BSQQS.13.4.A04.1.454.light.4.raw

SEQ ID NO: 546167 - DNA, 449 bp, Homo sapiens
  misc_feature: HIJSMM301ARG28.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccacccctcctccatactcgta

SEQ ID NO: 546168 - DNA, 485 bp, Homo sapiens
  misc_feature: HIJSMM301AJ67F.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagtcgggtggaggctgaggacgttggaatttattactgtatgcaaggtatagagcttcctccgacgttcggccaagggaccgaaggtggaactcaaacgaactgtggctgcaccatctgtcttcatcttcccgccatctgactagtctacg

SEQ ID NO: 546169 - DNA, 527 bp, Homo sapiens
  misc_feature: HIJSMM301ADRH8.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcgcggacggaccgacgacgaagtaagtagacgaacgaacgtaggtcgtcgtcgaccgactactcgtcttctactacttcccgtccccg

SEQ ID NO: 546170 - DNA, 495 bp, Homo sapiens; identical to SEQ ID NO: 545507
  misc_feature: HIJSMM301BVPK9.49.22.B11.1.454.light.4.raw

SEQ ID NO: 546171 - DNA, 502 bp, Homo sapiens
  misc_feature: HIJSMM301AKYI5.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 546172 - DNA, 480 bp, Homo sapiens
  misc_feature: HIJSMM301DDFH9.48.28.C06.1.454.light.4.raw
agtatacatacacgaccggtgctcgatttagagctcacgtattgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttttcggcgggagggaccgaagactgaccggtcctaacgtcagccc

SEQ ID NO: 546173 - DNA, 488 bp, Homo sapiens; identical to SEQ ID NO: 545628
  misc_feature: HIJSMM301CPLO0.14.55.E11.1.454.light.4.raw

SEQ ID NO: 546174 - DNA, 469 bp, Homo sapiens; identical to SEQ ID NO: 536091
  misc_feature: HIJSMM301CK2GF.3.82.H05.1.454.light.4.raw

SEQ ID NO: 546175 - DNA, 463 bp, Homo sapiens
  misc_feature: HIJSMM301DBIVN.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccacctcctcctagtctacg

SEQ ID NO: 546176 - DNA, 505 bp, Homo sapiens; identical to SEQ ID NO: 535503
  misc_feature: HIJSMM301CIV84.8.28.C06.1.454.light.4.raw

SEQ ID NO: 546177 - DNA, 489 bp, Homo sapiens; identical to SEQ ID NO: 536663
  misc_feature: HIJSMM301BGAKC.16.72.G06.1.454.light.4.raw

SEQ ID NO: 546178 - DNA, 512 bp, Homo sapiens
  misc_feature: HIJSMM301BHE2Y.17.23.C01.1.454.light.4.raw
cgtagactagcacgaccggtgctcgatttagtacacgtgattagggattggggctgggcctaaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctgcgggggaaggaacattggaagtaaaagtgtgcagtggtaccagcagaagccaggccaggcccctattctggtcgtctatgatgatagcgaccggccctcagggatccctgagcgattctctggctccaactctgacaacacggccaccctgaccatcagtagggtcggagccggggatgagggcgactattactgtcaggtgtgggatcacactagtgatcattatgtcttcggatcggggaccgaggtcaccgtcctaggtcagcccaaggccaaccccactgtcactctcgttcccgt

SEQ ID NO: 546179 - DNA, 495 bp, Homo sapiens; identical to SEQ ID NO: 535596
  misc_feature: HIJSMM301E3RZF.10.79.H02.1.454.light.4.raw

SEQ ID NO: 546180 - DNA, 508 bp, Homo sapiens; identical to SEQ ID NO: 536062
  misc_feature: HIJSMM301C7DWB.11.57.F02.1.454.light.4.raw

SEQ ID NO: 546181 - DNA, 505 bp, Homo sapiens
  misc_feature: HIJSMM301A1S29.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggctccaactctgggaacacagccactctgaccatcagcgggacccaggctatggatgaggctgacttttactgtcaggcgtgggacaccaacactgtggttttcggcggagggaccaagctgaccgtcctaggtcagcccaaggctgccccctcggtcactctgttccca

SEQ ID NO: 546182 - DNA, 494 bp, Homo sapiens; identical to SEQ ID NO: 534992
  misc_feature: HIJSMM301CP6MZ.9.1.A01.1.454.light.4.raw

SEQ ID NO: 546183 - DNA, 472 bp, Homo sapiens
  misc_feature: HIJSMM301CLZHN.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaataccctccatacacttttggccaggggaccaagctggagatcagaacg

SEQ ID NO: 546184 - DNA, 479 bp, Homo sapiens; identical to SEQ ID NO: 535118
  misc_feature: HIJSMM301BM9BF.13.59.F04.1.454.light.4.raw

SEQ ID NO: 546185 - DNA, 511 bp, Homo sapiens
  misc_feature: HIJSMM301B2XFI.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgcccctcggtcactctgttcccacctcct

SEQ ID NO: 546186 - DNA, 489 bp, Homo sapiens
  misc_feature: HIJSMM301DNXHB.52.85.H08.1.454.light.4.raw
cgcagtacgacacgaccggtgctcgatttagtatcactcagtcgcggggctgggcctcaggaagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaattgggggaaaatatgcttgctggtatcaacagcggccaggccagtcccctgtactggtcatctatctgaatagtaggcggccctctgggatccctgaccgattctctggctcccactctgggaacacagccactctgaccatcagcgggacccaggctttggatgaggctgactattactgtcaggcgtgggacaccatcactggagtaatattcggcggagggaccaggctgaccgtcctaggtcagcccaaggctgccccctcggt

SEQ ID NO: 546187 - DNA, 506 bp, Homo sapiens
  misc_feature: HIJSMM301EJUNU.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaataagaggtcaaacgaaactgtggctggcaccatctgtcttcatt

SEQ ID NO: 546188 - DNA, 496 bp, Homo sapiens; identical to SEQ ID NO: 545280
  misc_feature: HIJSMM301EMIDE.18.59.F04.1.454.light.4.raw

SEQ ID NO: 546189 - DNA, 489 bp, Homo sapiens
  misc_feature: HIJSMM301A7W9R.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttatactgtcaacaatattatattattccgaggacgttcggccaagggaccaaggtggaaatcaaacgaactgtggctgcaccatctgtcttcatctcccgcat

SEQ ID NO: 546190 - DNA, 492 bp, Homo sapiens
  misc_feature: HIJSMM301A4ITL.41.72.G06.1.454.light.4.raw
tctatactatcacgaccggtgctcgatttagctacgactgcaagggaaaggggaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatgggacagcagcctcacaaattggatgttcggcggagggaccaagctgaccgtcctaggtcagcccaaggcc

SEQ ID NO: 546191 - DNA, 507 bp, Homo sapiens; identical to SEQ ID NO: 538313
  misc_feature: HIJSMM301B98MI.7.71.G05.1.454.light.4.raw

SEQ ID NO: 546192 - DNA, 486 bp, Homo sapiens; identical to SEQ ID NO: 535043
  misc_feature: HIJSMM301CODXY.46.35.D02.1.454.light.4.raw

SEQ ID NO: 546193 - DNA, 472 bp, Homo sapiens
  misc_feature: HIJSMM301CL1WU.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccaaggtaggaatacaaacgaactagt

SEQ ID NO: 546194 - DNA, 485 bp, Homo sapiens
  misc_feature: HIJSMM301CSHF0.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttggccaagggaccaaggtggaaagtacaaacgaactgtggctgcaccca

SEQ ID NO: 546195 - DNA, 478 bp, Homo sapiens; identical to SEQ ID NO: 535129
  misc_feature: HIJSMM301CGA4V.11.11.A11.1.454.light.4.raw

SEQ ID NO: 546196 - DNA, 495 bp, Homo sapiens; identical to SEQ ID NO: 537716
  misc_feature: HIJSMM301A3AUN.22.14.B03.1.454.light.4.raw

SEQ ID NO: 546197 - DNA, 506 bp, Homo sapiens
  misc_feature: HIJSMM301EJQC4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatctgtcttctatcttccccg

SEQ ID NO: 546198 - DNA, 502 bp, Homo sapiens
  misc_feature: HIJSMM301DPQ16.13.11.A11.1.454.light.4.raw
tcacgtactacacgaccggtgctcgatttagctacgactgcgggtaaggaagggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctgtt

SEQ ID NO: 546199 - DNA, 488 bp, Homo sapiens; identical to SEQ ID NO: 540342
  misc_feature: HIJSMM301EATTP.43.33.C11.1.454.light.4.raw

SEQ ID NO: 546200 - DNA, 494 bp, Homo sapiens
  misc_feature: HIJSMM301EQA9H.13.39.D06.1.454.light.4.raw
tcacgtactacacgaccggtgctcgatttagtgacatctcgcagttctttgggggctacaacaggcaggcaggggcgagcaagatggtgttgcagacccacggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaa

SEQ ID NO: 546201 - DNA, 492 bp, Homo sapiens
  misc_feature: HIJSMM301CUEHI.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggccagggacccaggtggagatcagacgaactgtggctgcaccatctgtcttcatcttccg

SEQ ID NO: 546202 - DNA, 483 bp, Homo sapiens
  misc_feature: HIJSMM301EI9BN.8.4.A04.1.454.light.4.raw
ctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagcccc

SEQ ID NO: 546203 - DNA, 511 bp, Homo sapiens
  misc_feature: HIJSMM301BLO2U.5.58.F03.1.454.light.4.raw
atcagacacgcacgaccggtgctcgatttagtctgatcgagaagggaaaggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctcg

SEQ ID NO: 546204 - DNA, 486 bp, Homo sapiens; identical to SEQ ID NO: 535458
  misc_feature: HIJSMM301DBUJO.7.75.G09.1.454.light.4.raw

SEQ ID NO: 546205 - DNA, 513 bp, Homo sapiens
  misc_feature: HIJSMM301BX89F.51.53.E09.1.454.light.4.raw
cgatcgtatacacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaaacacttgggtgttcggcggcgggaccaaactgaccgtcctacgtcagcccaaggctgccccctcggtcactctgtt

SEQ ID NO: 546206 - DNA, 515 bp, Homo sapiens
  misc_feature: HIJSMM301CH1QF.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccaacgggaccgaaggtaggaaggtacaaacgaaactagtggcgtgcaccatctgtcttctatcttcccgtcccact

SEQ ID NO: 546207 - DNA, 503 bp, Homo sapiens
  misc_feature: HIJSMM301BTSLF.48.78.H01.1.454.light.4.raw
agtatacatacacgaccggtgctcgatttagtgtgagtagtttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcgagggaccaagctgaccgtcctaggtcagcccaaggctgccccccg

SEQ ID NO: 546208 - DNA, 478 bp, Homo sapiens
  misc_feature: HIJSMM301C97CD.16.81.H04.1.454.light.4.raw
tgtactactccacgaccggtgctcgatttagtagtgtagattcgcgggggcaggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggcctgggaccaatgtggatatcaaacgaactgtggctgcacc

SEQ ID NO: 546209 - DNA, 473 bp, Homo sapiens
  misc_feature: HIJSMM301A91BE.40.23.C01.1.454.light.4.raw
tctagcgactcacgaccggtgctcgatttagtacacgtgattagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgacatcagcgggacccaggctatggatgaggctgactattactgtcaggcgtgggacatcagcagtgaggtggttttcggcggagggaccaagctgaccgtcctaagtcagccc

SEQ ID NO: 546210 - DNA, 502 bp, Homo sapiens
  misc_feature: HIJSMM301AU2C6.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcgggacgttcggtccaacgggaccgaacggtaggaaggtcaaacgaaactagtggcgtgcaccactctgtctt

SEQ ID NO: 546211 - DNA, 460 bp, Homo sapiens; identical to SEQ ID NO: 537107
  misc_feature: HIJSMM301C7OB2.22.28.C06.1.454.light.4.raw

SEQ ID NO: 546212 - DNA, 478 bp, Homo sapiens; identical to SEQ ID NO: 535129
  misc_feature: HIJSMM301DUXVH.11.11.A11.1.454.light.4.raw

SEQ ID NO: 546213 - DNA, 494 bp, Homo sapiens; identical to SEQ ID NO: 534992
  misc_feature: HIJSMM301BBCR7.9.1.A01.1.454.light.4.raw

SEQ ID NO: 546214 - DNA, 513 bp, Homo sapiens
  misc_feature: HIJSMM301AJQXL.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgacttctcaggctccctccttgggggcgaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccta

SEQ ID NO: 546215 - DNA, 503 bp, Homo sapiens
  misc_feature: HIJSMM301EZJ80.22.21.B10.1.454.light.4.raw
acatacgcgtcacgaccggtgctcgatttagtgtcgtcgcaagggggggtcgtcaggaggcagcgctctcaggacgtcaccaccatggcctgggcgtctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaacctcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 546216 - DNA, 512 bp, Homo sapiens
  misc_feature: HIJSMM301AFW9J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacggaccgaacggtggaaagtacgaaacgaaactagtggcgtgcaccatctgtcttctatcttccccg

SEQ ID NO: 546217 - DNA, 497 bp, Homo sapiens; identical to SEQ ID NO: 539058
  misc_feature: HIJSMM301ASMWE.12.87.H10.1.454.light.4.raw

SEQ ID NO: 546218 - DNA, 520 bp, Homo sapiens
  misc_feature: HIJSMM301DAPR7.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 546219 - DNA, 508 bp, Homo sapiens
  misc_feature: HIJSMM301AJCB1.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaggtaggaggtcaagcgaactgtggctgcaccatctgtcttcatcttcccgcca

SEQ ID NO: 546220 - DNA, 487 bp, Homo sapiens; identical to SEQ ID NO: 535583
  misc_feature: HIJSMM301ES9WE.22.73.G07.1.454.light.4.raw

SEQ ID NO: 546221 - DNA, 517 bp, Homo sapiens; identical to SEQ ID NO: 536980
  misc_feature: HIJSMM301EJSTN.5.27.C05.1.454.light.4.raw

SEQ ID NO: 546222 - DNA, 444 bp, Homo sapiens; identical to SEQ ID NO: 535192
  misc_feature: HIJSMM301A8NIT.5.9.A09.1.454.light.4.raw

SEQ ID NO: 546223 - DNA, 493 bp, Homo sapiens; identical to SEQ ID NO: 535657
  misc_feature: HIJSMM301DLFJD.27.78.H01.1.454.light.4.raw

SEQ ID NO: 546224 - DNA, 486 bp, Homo sapiens
  misc_feature: HIJSMM301AOFZM.48.53.E09.1.454.light.4.raw
agtatacatacacgaccggtgctcgatttagagagagtgtgttgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtca

SEQ ID NO: 546225 - DNA, 486 bp, Homo sapiens; identical to SEQ ID NO: 535043
  misc_feature: HIJSMM301AOQJI.46.35.D02.1.454.light.4.raw

SEQ ID NO: 546226 - DNA, 508 bp, Homo sapiens
  misc_feature: HIJSMM301AUUXI.53.71.G05.1.454.light.4.raw
cgcgtatacacacgaccggtgctcgatttagtgtcgtcgcaagagagagggggtgtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctcg

SEQ ID NO: 546227 - DNA, 502 bp, Homo sapiens
  misc_feature: HIJSMM301BN63Q.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctcgtcctacgtcagccaaggccaactccactgtcact

SEQ ID NO: 546228 - DNA, 507 bp, Homo sapiens
  misc_feature: HIJSMM301EQQHC.48.53.E09.1.454.light.4.raw
agtatacatacacgaccggtgctcgatttagagagagtgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 546229 - DNA, 483 bp, Homo sapiens
  misc_feature: HIJSMM301A5PE7.52.53.E09.1.454.light.4.raw
cgcagtacgacacgaccggtgctcgatttagagagagtgtgttgggtttggggaggagctctggggagtctgcaccatggcttggaccccactcctcttcctcacccacctcctccactgcacagggtctctctcccagcctgtgctgactcaatcgccctctgactctgcctccctggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaagttgaccgtctaggtcagcccaaggctcg

SEQ ID NO: 546230 - DNA, 504 bp, Homo sapiens
  misc_feature: HIJSMM301DGBFH.51.2.A02.1.454.light.4.raw
cgatcgtatacacgaccggtgctcgatttagactcatctacaggggagtctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaaccccactgtcactctgttcccta

SEQ ID NO: 546231 - DNA, 506 bp, Homo sapiens
  misc_feature: HIJSMM301AMVT8.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaaactgtggctgcaccatctgtcttcatcttcccgccat

SEQ ID NO: 546232 - DNA, 490 bp, Homo sapiens
  misc_feature: HIJSMM301A536G.51.28.C06.1.454.light.4.raw
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggt

SEQ ID NO: 546233 - DNA, 462 bp, Homo sapiens
  misc_feature: HIJSMM301EXLJF.52.8.A08.1.454.light.4.raw
cgcagtacgacacgaccggtgctcgatttagcatactctacagggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaa

SEQ ID NO: 546234 - DNA, 442 bp, Homo sapiens
  misc_feature: HIJSMM301BYDQT.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctcgttcccgccctcctcatagtataga

SEQ ID NO: 546235 - DNA, 416 bp, Homo sapiens; identical to SEQ ID NO: 539343
  misc_feature: HIJSMM301CEJXQ.18.78.H01.1.454.light.4.raw

SEQ ID NO: 546236 - DNA, 498 bp, Homo sapiens
  misc_feature: HIJSMM301BXPJE.52.38.D05.1.454.light.4.raw
cgcagtacgacacgaccggtgctcgatttagtatctgatagttgggtttggggggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttcccg

SEQ ID NO: 546237 - DNA, 488 bp, Homo sapiens
  misc_feature: HIJSMM301A30XD.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 546238 - DNA, 514 bp, Homo sapiens
  misc_feature: HIJSMM301EVMT0.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccg

SEQ ID NO: 546239 - DNA, 460 bp, Homo sapiens; identical to SEQ ID NO: 539553
  misc_feature: HIJSMM301BKLGL.11.86.H09.1.454.light.4.raw

SEQ ID NO: 546240 - DNA, 485 bp, Homo sapiens; identical to SEQ ID NO: 536040
  misc_feature: HIJSMM301AXRFG.15.1.A01.1.454.light.4.raw

SEQ ID NO: 546241 - DNA, 498 bp, Homo sapiens; identical to SEQ ID NO: 535469
  misc_feature: HIJSMM301A1AOG.12.18.B07.1.454.light.4.raw

SEQ ID NO: 546242 - DNA, 516 bp, Homo sapiens
  misc_feature: HIJSMM301C9BMF.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggcgaggctgattattactgcagctcatatgacagatacaagtcctgggtgttcggcggtagggaccgaaggcgtacgaaccggtcctagggtccacgacccaaggctcggccccctcggt

SEQ ID NO: 546243 - DNA, 499 bp, Homo sapiens
  misc_feature: HIJSMM301BK6UA.22.14.B03.1.454.light.4.raw
acatacgcgtcacgaccggtgctcgatttagtgtgagtagttccgcgggggaggctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaaactgtggctgcacca

SEQ ID NO: 546244 - DNA, 504 bp, Homo sapiens; identical to SEQ ID NO: 537470
  misc_feature: HIJSMM301DU9DU.18.37.D04.1.454.light.4.raw

SEQ ID NO: 546245 - DNA, 484 bp, Homo sapiens; identical to SEQ ID NO: 535400
  misc_feature: HIJSMM301CI7GP.46.26.C04.1.454.light.4.raw

SEQ ID NO: 546246 - DNA, 495 bp, Homo sapiens; identical to SEQ ID NO: 535007
  misc_feature: HIJSMM301D92H0.22.5.A05.1.454.light.4.raw

SEQ ID NO: 546247 - DNA, 495 bp, Homo sapiens; identical to SEQ ID NO: 535596
  misc_feature: HIJSMM301CW7AN.10.79.H02.1.454.light.4.raw

SEQ ID NO: 546248 - DNA, 444 bp, Homo sapiens; identical to SEQ ID NO: 535192
  misc_feature: HIJSMM301BQE10.5.9.A09.1.454.light.4.raw

SEQ ID NO: 546249 - DNA, 514 bp, Homo sapiens; identical to SEQ ID NO: 546238
  misc_feature: HIJSMM301CBPA2.47.85.H08.1.454.light.4.raw

SEQ ID NO: 546250 - DNA, 488 bp, Homo sapiens; identical to SEQ ID NO: 536554
  misc_feature: HIJSMM301BWOHF.26.37.D04.1.454.light.4.raw

SEQ ID NO: 546251 - DNA, 499 bp, Homo sapiens
  misc_feature: HIJSMM301CYSCC.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctcgggaccaaagtggatatcaaacgaaactgtggctgcaccatctgtcttcatcttcccgccat

SEQ ID NO: 546252 - DNA, 498 bp, Homo sapiens
  misc_feature: HIJSMM301CF8BA.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggacccaaggtggaaatcaaacgaactgtggctgcacca

SEQ ID NO: 546253 - DNA, 497 bp, Homo sapiens; identical to SEQ ID NO: 538061
  misc_feature: HIJSMM301CXF1W.16.46.E02.1.454.light.4.raw

SEQ ID NO: 546254 - DNA, 484 bp, Homo sapiens; identical to SEQ ID NO: 535400
  misc_feature: HIJSMM301DE70U.46.26.C04.1.454.light.4.raw

SEQ ID NO: 546255 - DNA, 489 bp, Homo sapiens; identical to SEQ ID NO: 535386
  misc_feature: HIJSMM301C7YX0.12.51.E07.1.454.light.4.raw

SEQ ID NO: 546256 - DNA, 520 bp, Homo sapiens
  misc_feature: HIJSMM301C2LCL.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgacttattttgtcacgtgtggcacgttagtcatcacgtcttcggaactgggaccacggtcaccgtcctaagtcagcccaaggccaaccccactcgtcactctcgttcccaccctcctcagtcgct

SEQ ID NO: 546257 - DNA, 441 bp, Homo sapiens
  misc_feature: HIJSMM301A7W2P.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 546258 - DNA, 499 bp, Homo sapiens
  misc_feature: HIJSMM301BKGY0.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactgggctcaggcggaagatgaggctgactattactgtaactcccgggacagcagtgctgaccaggtggtattcggcggagggacccacctgaccgtctaggtcagcccaaggctgccccctcggtca

SEQ ID NO: 546259 - DNA, 490 bp, Homo sapiens; identical to SEQ ID NO: 535526
  misc_feature: HIJSMM301CF8D0.26.78.H01.1.454.light.4.raw

SEQ ID NO: 546260 - DNA, 487 bp, Homo sapiens; identical to SEQ ID NO: 541583
  misc_feature: HIJSMM301AJSZE.41.57.F02.1.454.light.4.raw

SEQ ID NO: 546261 - DNA, 514 bp, Homo sapiens; identical to SEQ ID NO: 538885
  misc_feature: HIJSMM301DD5A9.14.19.B08.1.454.light.4.raw

SEQ ID NO: 546262 - DNA, 501 bp, Homo sapiens; identical to SEQ ID NO: 535746
  misc_feature: HIJSMM301B3MPP.18.11.A11.1.454.light.4.raw

SEQ ID NO: 546263 - DNA, 486 bp, Homo sapiens; identical to SEQ ID NO: 535043
  misc_feature: HIJSMM301BH6US.46.35.D02.1.454.light.4.raw

SEQ ID NO: 546264 - DNA, 492 bp, Homo sapiens
  misc_feature: HIJSMM301CA916.14.5.A05.1.454.light.4.raw
cgtctagtaccacgaccggtgctcgatttagatagatagacaggggggaactgctcagttaggacccagagggaaccatggaagccccagctcagcttctcttcctcctgctactctggctcccagataccaccggagaaattgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttca

SEQ ID NO: 546265 - DNA, 487 bp, Homo sapiens; identical to SEQ ID NO: 546164
  misc_feature: HIJSMM301DU7I3.5.6.A06.1.454.light.4.raw

SEQ ID NO: 546266 - DNA, 484 bp, Homo sapiens; identical to SEQ ID NO: 535400
  misc_feature: HIJSMM301AY6DY.46.26.C04.1.454.light.4.raw

SEQ ID NO: 546267 - DNA, 505 bp, Homo sapiens
  misc_feature: HIJSMM301CTKYW.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggccaacccactgcactctgt

SEQ ID NO: 546268 - DNA, 512 bp, Homo sapiens
  misc_feature: HIJSMM301CIRWM.15.86.H09.1.454.light.4.raw
tctacgtagccacgaccggtgctcgatttagtgctatagacttgggtttgggggacttccctggtctccttctacctactgcccttcatttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccacctcctcgctacgtagac

SEQ ID NO: 546269 - DNA, 494 bp, Homo sapiens; identical to SEQ ID NO: 534994
  misc_feature: HIJSMM301A79E9.27.78.H01.1.454.light.4.raw

SEQ ID NO: 546270 - DNA, 455 bp, Homo sapiens
  misc_feature: HIJSMM301DBV50.19.86.H09.1.454.light.4.raw
tactctcgtgcacgaccggtgctcgatttagtgctatagacttggggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcgagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 546271 - DNA, 483 bp, Homo sapiens
  misc_feature: HIJSMM301DVPO7.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccaggggaccaggctggagatcagactaactgtgg

SEQ ID NO: 546272 - DNA, 444 bp, Homo sapiens; identical to SEQ ID NO: 535192
  misc_feature: HIJSMM301AH807.5.9.A09.1.454.light.4.raw

SEQ ID NO: 546273 - DNA, 485 bp, Homo sapiens
  misc_feature: HIJSMM301C4NYZ.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 546274 - DNA, 499 bp, Homo sapiens
  misc_feature: HIJSMM301EWRMI.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggtccacttttggccaggggaccaagctggagatcaaacgaactgtggctgcaccatctgtcttcatt

SEQ ID NO: 546275 - DNA, 495 bp, Homo sapiens; identical to SEQ ID NO: 535486
  misc_feature: HIJSMM301AP8LU.26.72.G06.1.454.light.4.raw

SEQ ID NO: 546276 - DNA, 497 bp, Homo sapiens
  misc_feature: HIJSMM301C3V8I.49.69.G03.1.454.light.4.raw
agtcgagagacacgaccggtgctcgatttagtcgctgcgtaaaggagaaaggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactctcg

SEQ ID NO: 546277 - DNA, 492 bp, Homo sapiens
  misc_feature: HIJSMM301AG668.10.79.H02.1.454.light.4.raw
catagtagtgcacgaccggtgctcgatttagtgtcacacgaagggaaaggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttc

SEQ ID NO: 546278 - DNA, 488 bp, Homo sapiens
  misc_feature: HIJSMM301CY94M.43.33.C11.1.454.light.4.raw
  modified_base (364)..(364): a, c, t, g, unknown or other
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttcnctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 546279 - DNA, 447 bp, Homo sapiens; identical to SEQ ID NO: 535882
  misc_feature: HIJSMM301EMXMU.18.9.A09.1.454.light.4.raw
  modified_base (429)..(429): a, c, t, g, unknown or other

SEQ ID NO: 546280 - DNA, 491 bp, Homo sapiens; identical to SEQ ID NO: 538021
  misc_feature: HIJSMM301CAM8Q.3.72.G06.1.454.light.4.raw

SEQ ID NO: 546281 - DNA, 492 bp, Homo sapiens
  misc_feature: HIJSMM301AT584.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatacaaacgaa

SEQ ID NO: 546282 - DNA, 488 bp, Homo sapiens; identical to SEQ ID NO: 537260
  misc_feature: HIJSMM301BDQRB.47.70.G04.1.454.light.4.raw

SEQ ID NO: 546283 - DNA, 505 bp, Homo sapiens
  misc_feature: HIJSMM301EUCF3.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctcgggtcagcccaaggctcgccccctcggt

SEQ ID NO: 546284 - DNA, 514 bp, Homo sapiens; identical to SEQ ID NO: 538515
  misc_feature: HIJSMM301BWV1R.17.37.D04.1.454.light.4.raw

SEQ ID NO: 546285 - DNA, 494 bp, Homo sapiens; identical to SEQ ID NO: 534994
  misc_feature: HIJSMM301D9RBS.27.78.H01.1.454.light.4.raw

SEQ ID NO: 546286 - DNA, 502 bp, Homo sapiens
  misc_feature: HIJSMM301AO3ZG.48.70.G04.1.454.light.4.raw
agtatacatacacgaccggtgctcgatttagtgtagtgtgaagggaaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactagtggctgcaccatctgtcttcatcttcccgccta

SEQ ID NO: 546287 - DNA, 490 bp, Homo sapiens
  misc_feature: HIJSMM301CHVVW.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccgaaggtggagatcaaacgaactgtggctgcaccat

SEQ ID NO: 546288 - DNA, 505 bp, Homo sapiens; identical to SEQ ID NO: 535503
  misc_feature: HIJSMM301EXBDQ.8.28.C06.1.454.light.4.raw

SEQ ID NO: 546289 - DNA, 493 bp, Homo sapiens; identical to SEQ ID NO: 535745
  misc_feature: HIJSMM301BHHQT.47.78.H01.1.454.light.4.raw

SEQ ID NO: 546290 - DNA, 516 bp, Homo sapiens; identical to SEQ ID NO: 535549
  misc_feature: HIJSMM301B0LZ4.14.70.G04.1.454.light.4.raw

SEQ ID NO: 546291 - DNA, 503 bp, Homo sapiens; identical to SEQ ID NO: 535044
  misc_feature: HIJSMM301DNQO6.19.78.H01.1.454.light.4.raw

SEQ ID NO: 546292 - DNA, 490 bp, Homo sapiens
  misc_feature: HIJSMM301D3BYC.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttaattctccagcgttcggccagggaccgaaggtggaagtacaagcgaactagtggctgcaccaatct

SEQ ID NO: 546293 - DNA, 447 bp, Homo sapiens; identical to SEQ ID NO: 535020
  misc_feature: HIJSMM301C8ZEM.18.9.A09.1.454.light.4.raw

SEQ ID NO: 546294 - DNA, 470 bp, Homo sapiens
  misc_feature: HIJSMM301CC07Z.49.73.G07.1.454.light.4.raw
agtcgagagacacgaccggtgctcgatttagctctacgctcaggggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtggctgcacc

SEQ ID NO: 546295 - DNA, 513 bp, Homo sapiens
  misc_feature: HIJSMM301AKL4K.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctcgccccctcggtcactctcgttcccta

SEQ ID NO: 546296 - DNA, 493 bp, Homo sapiens
  misc_feature: HIJSMM301BXNM4.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaacctcctacaacgttcggcggaggaccaaggtggagatacaaacgaactgtgctgcaccatctgtcttcta

SEQ ID NO: 546297 - DNA, 488 bp, Homo sapiens; identical to SEQ ID NO: 536554
  misc_feature: HIJSMM301ARC96.26.37.D04.1.454.light.4.raw

SEQ ID NO: 546298 - DNA, 495 bp, Homo sapiens; identical to SEQ ID NO: 535486
  misc_feature: HIJSMM301A4792.26.72.G06.1.454.light.4.raw

SEQ ID NO: 546299 - DNA, 497 bp, Homo sapiens; identical to SEQ ID NO: 535286
  misc_feature: HIJSMM301C9ZFN.18.59.F04.1.454.light.4.raw

SEQ ID NO: 546300 - DNA, 496 bp, Homo sapiens
  misc_feature: HIJSMM301EN2JV.49.22.B11.1.454.light.4.raw
agtcgagagacacgaccggtgctcgatttagacgacagctcagggggaggaactgctcagttaggacccagagggaaccatggaagccccagctcagcttctcttcctcctgctactctggctcccagatatttccgaagaaattgtgttgacacagtctccagccaccctctatctgtctccaggggaaagagccaccctctcctgcagggccagtcagagtgttaacaacttcttaggctggtatcaacaaaaacctggccaggttcccaggctcctcgtctatgatgcgtccatcagggccactggcatcccagccaggttcagtggcagtgggtctgggacagacttcactctcaccatcagcagcctagagcctgaagactttgcagtttattactgtcagcagcgtagcaatttgatcaccttcggccaagggacacgactaggaaattaaacgaactgtggctgcaccatctgtcttcatcttcccgcc

SEQ ID NO: 546301 - DNA, 503 bp, Homo sapiens; identical to SEQ ID NO: 541454
  misc_feature: HIJSMM301CKIY3.9.12.B01.1.454.light.4.raw

SEQ ID NO: 546302 - DNA, 494 bp, Homo sapiens; identical to SEQ ID NO: 534992
  misc_feature: HIJSMM301C217X.9.1.A01.1.454.light.4.raw

SEQ ID NO: 546303 - DNA, 444 bp, Homo sapiens; identical to SEQ ID NO: 535192
  misc_feature: HIJSMM301EFIL1.5.9.A09.1.454.light.4.raw

SEQ ID NO: 546304 - DNA, 490 bp, Homo sapiens
  misc_feature: HIJSMM301C358R.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctcgtccccccg

SEQ ID NO: 546305 - DNA, 496 bp, Homo sapiens; identical to SEQ ID NO: 535109
  misc_feature: HIJSMM301AIRGY.16.78.H01.1.454.light.4.raw

SEQ ID NO: 546306 - DNA, 494 bp, Homo sapiens; identical to SEQ ID NO: 535478
  misc_feature: HIJSMM301DRM2Y.10.79.H02.1.454.light.4.raw

SEQ ID NO: 546307 - DNA, 509 bp, Homo sapiens
  misc_feature: HIJSMM301CU6MW.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaacccactgtcactctgttcccaccctcctccgtgtctgat

SEQ ID NO: 546308 - DNA, 485 bp, Homo sapiens
  misc_feature: HIJSMM301CGHYA.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaaggggacacgactggagattaaacgaactgtggctgcaccat

SEQ ID NO: 546309 - DNA, 497 bp, Homo sapiens
  misc_feature: HIJSMM301AJQ8Y.13.11.A11.1.454.light.4.raw
tcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcact

SEQ ID NO: 546310 - DNA, 496 bp, Homo sapiens; identical to SEQ ID NO: 535109
  misc_feature: HIJSMM301A548S.16.78.H01.1.454.light.4.raw

SEQ ID NO: 546311 - DNA, 500 bp, Homo sapiens
  misc_feature: HIJSMM301BFH46.2.49.E05.1.454.light.4.raw
acgctcgacacacgaccggtgctcgatttagagcgactagcaacacacaaaggggggggaaggctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctaccaagtctggcacctcagcctccctggccatcagtgggctccggtccgaggatgaggctgattattactgtgttggatgggacagcagcctgagtgcttatgtcttcggaactgggaccacggtcaccggtcct

SEQ ID NO: 546312 - DNA, 487 bp, Homo sapiens; identical to SEQ ID NO: 535583
  misc_feature: HIJSMM301BX9O3.22.73.G07.1.454.light.4.raw

SEQ ID NO: 546313 - DNA, 480 bp, Homo sapiens
  misc_feature: HIJSMM301ADUWE.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtggcagtggatctgggacagatttcactctcaccatcagcagtctacaacctgaagattttgcaacttactactgtcaacagagtttcagtacccctctgacgttcggccaagggaccaaggtggaaataaaacgaactgtgg

SEQ ID NO: 546314 - DNA, 508 bp, Homo sapiens; identical to SEQ ID NO: 536388
  misc_feature: HIJSMM301B6FXV.11.57.F02.1.454.light.4.raw

SEQ ID NO: 546315 - DNA, 489 bp, Homo sapiens
  misc_feature: HIJSMM301CPPMR.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctacaatttcggtcaggggaccaagttgaacatcaatcgaactgtggctgcacca

SEQ ID NO: 546316 - DNA, 503 bp, Homo sapiens; identical to SEQ ID NO: 541600
  misc_feature: HIJSMM301AWSNI.13.55.E11.1.454.light.4.raw

SEQ ID NO: 546317 - DNA, 482 bp, Homo sapiens; identical to SEQ ID NO: 540521
  misc_feature: HIJSMM301AMF0H.21.25.C03.1.454.light.4.raw

SEQ ID NO: 546318 - DNA, 496 bp, Homo sapiens
  misc_feature: HIJSMM301D40TS.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggaggaccaagctgaccgtcctaggtcagcccaaggctcg

SEQ ID NO: 546319 - DNA, 502 bp, Homo sapiens; identical to SEQ ID NO: 544632
  misc_feature: HIJSMM301CF9JE.48.67.G01.1.454.light.4.raw

SEQ ID NO: 546320 - DNA, 493 bp, Homo sapiens; identical to SEQ ID NO: 535745
  misc_feature: HIJSMM301EWGKK.47.78.H01.1.454.light.4.raw

SEQ ID NO: 546321 - DNA, 487 bp, Homo sapiens; identical to SEQ ID NO: 535142
  misc_feature: HIJSMM301EJF6R.19.71.G05.1.454.light.4.raw

SEQ ID NO: 546322 - DNA, 485 bp, Homo sapiens
  misc_feature: HIJSMM301ESM4G.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggacgaaggtggagatcaacgaa

SEQ ID NO: 546323 - DNA, 494 bp, Homo sapiens
  misc_feature: HIJSMM301DUU05.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 546324 - DNA, 494 bp, Homo sapiens; identical to SEQ ID NO: 542264
  misc_feature: HIJSMM301C7XXI.13.6.A06.1.454.light.4.raw

SEQ ID NO: 546325 - DNA, 500 bp, Homo sapiens
  misc_feature: HIJSMM301C41BE.49.30.C08.1.454.light.4.raw
agtcgagagacacgaccggtgctcgatttagtctgacgtcaaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactcgtcactctcg

SEQ ID NO: 546326 - DNA, 489 bp, Homo sapiens
  misc_feature: HIJSMM301CN6U6.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgtactagacg

SEQ ID NO: 546327 - DNA, 495 bp, Homo sapiens
  misc_feature: HIJSMM301ECURS.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatcaaacgaactagtggctgcaccatctgtcttcat

SEQ ID NO: 546328 - DNA, 383 bp, Homo sapiens; identical to SEQ ID NO: 447524
  misc_feature: HIJSMM301ETQDK.41.26.C04.1.454.light.4.raw

SEQ ID NO: 546329 - DNA, 493 bp, Homo sapiens; identical to SEQ ID NO: 535278
  misc_feature: HIJSMM301DI0H6.51.81.H04.1.454.light.4.raw

SEQ ID NO: 546330 - DNA, 507 bp, Homo sapiens
  misc_feature: HIJSMM301AGN1L.2.76.G10.1.454.light.4.raw
  modified_base (462)..(462): a, c, t, g, unknown or other
acgctcgacacacgaccggtgctcgatttagtcactcatacaggggggagagatctgggggaaggctcagcttcagctgtggtagagaagacaggattcaggacagtctccagcatggccggcttccctctcctcctcaccctcctcactcactgtgcagggtcctgggcccagtctgtgctgactcagccaccctcagcgtctcgggtcccccgggcagagggtcaccatctcttgttctggaggcacctccaacatcgggcgtgataatgtgtactggtacaagcaggtcccaggaacgacccccaactctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggacctgggacccaaggtccaccgtccttggtcc

SEQ ID NO: 546331 - DNA, 495 bp, Homo sapiens
  misc_feature: HIJSMM301BQ77E.5.55.E11.1.454.light.4.raw
atcagacacgcacgaccggtgctcgatttagcactcgcacgttgggtttggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccgggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaatcaaacgaactgtggctgca

SEQ ID NO: 546332 - DNA, 501 bp, Homo sapiens; identical to SEQ ID NO: 535873
  misc_feature: HIJSMM301AP9VC.17.27.C05.1.454.light.4.raw

SEQ ID NO: 546333 - DNA, 500 bp, Homo sapiens; identical to SEQ ID NO: 540484
  misc_feature: HIJSMM301BYQOP.48.73.G07.1.454.light.4.raw

SEQ ID NO: 546334 - DNA, 496 bp, Homo sapiens
  misc_feature: HIJSMM301BW1IE.43.34.D01.1.454.light.4.raw
tgtgagtagtcacgaccggtgctcgatttagatcgtctgtgttgggtttgggcacgaccggtgctcgatttagatcgtctgtgttgggtttgggggggtcgacaagaggcagcgctctcgggacggtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaacgcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttac

SEQ ID NO: 546335 - DNA, 480 bp, Homo sapiens; identical to SEQ ID NO: 535630
  misc_feature: HIJSMM301CU26G.40.59.F04.1.454.light.4.raw

SEQ ID NO: 546336 - DNA, 383 bp, Homo sapiens; identical to SEQ ID NO: 447524
  misc_feature: HIJSMM301AM4ED.41.26.C04.1.454.light.4.raw

SEQ ID NO: 546337 - DNA, 481 bp, Homo sapiens
  misc_feature: HIJSMM301EC94J.48.29.C07.1.454.light.4.raw
agtatacatacacgaccggtgctcgatttagagtgctacgaagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaacgcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggagggaccaagctgactgtcctaggt

SEQ ID NO: 546338 - DNA, 484 bp, Homo sapiens
  misc_feature: HIJSMM301DNPPU.52.69.G03.1.454.light.4.raw
cgcagtacgacacgaccggtgctcgatttagtcgctgcgtaaaggagaaaggggagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccatctgt

SEQ ID NO: 546339 - DNA, 500 bp, Homo sapiens
  misc_feature: HIJSMM301CFIJR.40.60.F05.1.454.light.4.raw
tctagcgactcacgaccggtgctcgatttagtacgtcatcagggaaagggggaagagctgctcagttaggacccagagggaaccatggaaaccccagcgcagcttctcttcctcctgctactctggctcccagagacccccggagaaattgtgttgacgcagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccg

SEQ ID NO: 546340 - DNA, 500 bp, Homo sapiens
  misc_feature: HIJSMM301A6C9M.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgtaccatctgtcttcatcttccg

SEQ ID NO: 546341 - DNA, 462 bp, Homo sapiens
  misc_feature: HIJSMM301EKG70.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggtcggagggaccgaagctgaccgtcctaggtcagcccaaggctgccccctcggtcactctgttcccaccctcctcgtatctctcg

SEQ ID NO: 546342 - DNA, 509 bp, Homo sapiens
  misc_feature: HIJSMM301DGD4W.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggcccgtcgggaccaaagtaggatatcaaacgaactgtggctgcaccatctgtctt

SEQ ID NO: 546343 - DNA, 466 bp, Homo sapiens; identical to SEQ ID NO: 535366
  misc_feature: HIJSMM301CWGU7.13.4.A04.1.454.light.4.raw

SEQ ID NO: 546344 - DNA, 486 bp, Homo sapiens; identical to SEQ ID NO: 535523
  misc_feature: HIJSMM301BK1IZ.22.73.G07.1.454.light.4.raw

SEQ ID NO: 546345 - DNA, 496 bp, Homo sapiens; identical to SEQ ID NO: 536802
  misc_feature: HIJSMM301DA4WU.5.24.C02.1.454.light.4.raw

SEQ ID NO: 546346 - DNA, 488 bp, Homo sapiens
  misc_feature: HIJSMM301APZL0.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcgccgaaggaccgaacggtggaactcaaacgaa

SEQ ID NO: 546347 - DNA, 501 bp, Homo sapiens
  misc_feature: HIJSMM301EIX7J.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctggtcactctgttcccaccctcctcacgcgtatgt

SEQ ID NO: 546348 - DNA, 498 bp, Homo sapiens
  misc_feature: HIJSMM301C73VY.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgcccctcggtcactctgttcccaccctcctccactactatg

SEQ ID NO: 546349 - DNA, 493 bp, Homo sapiens
  misc_feature: HIJSMM301AGB11.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctcgcgtggttttggtcgtgttcggtcggcgggaccgaacgacg

SEQ ID NO: 546350 - DNA, 500 bp, Homo sapiens
  misc_feature: HIJSMM301BT4GY.51.19.B08.1.454.light.4.raw
cgatcgtatacacgaccggtgctcgatttagtgagtcagtaagggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagcctgaggacgagtctcactactactgctcctcatatgcagacaatagtttcctggtgttcggcggagggaccaagttgaccgtcctaggtcagcccaaggctgccccctcggtcact

SEQ ID NO: 546351 - DNA, 517 bp, Homo sapiens
  misc_feature: HIJSMM301D01FZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgagatttgcaacttactactgtcaacagagttacagtaccccctcctacttacgttcggacgggacggaacgacgggcggagtacacgacgaacgtaacgttggtcggtcgtcgaccaacctacttcgttcttcctta

SEQ ID NO: 546352 - DNA, 528 bp, Homo sapiens
  misc_feature: HIJSMM301CZQJ8.27.23.C01.1.454.light.4.raw
  modified_base (238)..(238): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggngttttttctataactttatctgttggtaccgacaggacccaggcactgtccccaaactcattctttatgatgtcagtaatccggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccgccct

SEQ ID NO: 546353 - DNA, 484 bp, Homo sapiens; identical to SEQ ID NO: 535400
  misc_feature: HIJSMM301B6FNO.46.26.C04.1.454.light.4.raw

SEQ ID NO: 546354 - DNA, 509 bp, Homo sapiens; identical to SEQ ID NO: 539359
  misc_feature: HIJSMM301AGDSI.47.85.H08.1.454.light.4.raw

SEQ ID NO: 546355 - DNA, 485 bp, Homo sapiens; identical to SEQ ID NO: 536210
  misc_feature: HIJSMM301EDK9K.43.54.E10.1.454.light.4.raw

SEQ ID NO: 546356 - DNA, 502 bp, Homo sapiens; identical to SEQ ID NO: 537816
  misc_feature: HIJSMM301EM338.19.78.H01.1.454.light.4.raw

SEQ ID NO: 546357 - DNA, 497 bp, Homo sapiens; identical to SEQ ID NO: 536376
  misc_feature: HIJSMM301CZ0PW.22.9.A09.1.454.light.4.raw

SEQ ID NO: 546358 - DNA, 503 bp, Homo sapiens
  misc_feature: HIJSMM301EDLYL.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccgccctccc

SEQ ID NO: 546359 - DNA, 496 bp, Homo sapiens; identical to SEQ ID NO: 537925
  misc_feature: HIJSMM301A7LL7.22.14.B03.1.454.light.4.raw

SEQ ID NO: 546360 - DNA, 510 bp, Homo sapiens; identical to SEQ ID NO: 535855
  misc_feature: HIJSMM301CM4DM.17.33.C11.1.454.light.4.raw

SEQ ID NO: 546361 - DNA, 494 bp, Homo sapiens; identical to SEQ ID NO: 535276
  misc_feature: HIJSMM301D7YZX.16.6.A06.1.454.light.4.raw

SEQ ID NO: 546362 - DNA, 513 bp, Homo sapiens
  misc_feature: HIJSMM301DKFOS.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccaccctcctcgagtagtaca

SEQ ID NO: 546363 - DNA, 497 bp, Homo sapiens
  misc_feature: HIJSMM301BSOJ8.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 546364 - DNA, 506 bp, Homo sapiens; identical to SEQ ID NO: 534969
  misc_feature: HIJSMM301BWPIY.18.37.D04.1.454.light.4.raw

SEQ ID NO: 546365 - DNA, 486 bp, Homo sapiens; identical to SEQ ID NO: 535043
  misc_feature: HIJSMM301EBZGW.46.35.D02.1.454.light.4.raw

SEQ ID NO: 546366 - DNA, 510 bp, Homo sapiens
  misc_feature: HIJSMM301ATTXJ.48.67.G01.1.454.light.4.raw
agtatacatacacgaccggtgctcgatttagagtatacatattgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggcccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgtcgtcggacgggacggaacacgcgtacgacgtacgtaccggtacgtacgaccgaaccgaacggtccgtcccc

SEQ ID NO: 546367 - DNA, 494 bp, Homo sapiens; identical to SEQ ID NO: 535828
  misc_feature: HIJSMM301D5RFP.3.36.D03.1.454.light.4.raw

SEQ ID NO: 546368 - DNA, 490 bp, Homo sapiens
  misc_feature: HIJSMM301AF32T.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccacccgtccggtagtccaaggacttgagacagaccgccacactcacctgcactgggaacaacaacgaatgttggccacgacggagtcgtttggctgcagcagcaccagggccaccctcccaagctcctctccgacaggaataacatccggccctcaggggatctcagagagattctctgcatccaggtcaggaagcacagcctccctgaccattactggactccaggctgacgacgaagctgattattactgctcagcatgggacaccggcctcagtgcgtgggttttcggcgggagggaccaagctgaccgtcctaggtcagacccg

SEQ ID NO: 546369 - DNA, 473 bp, Homo sapiens
  misc_feature: HIJSMM301BHN8Z.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggtaccaaggtggacatcaaacgaa

SEQ ID NO: 546370 - DNA, 486 bp, Homo sapiens; identical to SEQ ID NO: 535043
  misc_feature: HIJSMM301BL38M.46.35.D02.1.454.light.4.raw

SEQ ID NO: 546371 - DNA, 489 bp, Homo sapiens; identical to SEQ ID NO: 546040
  misc_feature: HIJSMM301A8RW7.11.12.B01.1.454.light.4.raw

SEQ ID NO: 546372 - DNA, 493 bp, Homo sapiens
  misc_feature: HIJSMM301CDZ0Y.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaaacgaactgtggctgcaccatctgtcttcatcttcccg

SEQ ID NO: 546373 - DNA, 485 bp, Homo sapiens
  misc_feature: HIJSMM301DROYG.15.1.A01.1.454.light.4.raw
tctacgtagccacgaccggtgctcgatttagacgtctcatcagggcctgggctctgctgctcctcactctcctcactcaggacacagggtcctgggcccagtctgtcctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 546374 - DNA, 501 bp, Homo sapiens
  misc_feature: HIJSMM301EXXBS.48.29.C07.1.454.light.4.raw
agtatacatacacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgtcggtccagggaccaacggtaggaaagtacaaacgaaactagtggctgcacca

SEQ ID NO: 546375 - DNA, 482 bp, Homo sapiens
  misc_feature: HIJSMM301BLGHK.14.53.E09.1.454.light.4.raw
cgtctagtaccacgaccggtgctcgatttagagagagtgtgtgggtccaggaggcagaactctggatgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggt

SEQ ID NO: 546376 - DNA, 489 bp, Homo sapiens
  misc_feature: HIJSMM301DRPVA.43.29.C07.1.454.light.4.raw
tgtgagtagtcacgaccggtgctcgatttagagtgctacgaagggaaaggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccaggtggagatcaaacgaactgtggctgcaccatctgtcttc

SEQ ID NO: 546377 - DNA, 488 bp, Homo sapiens; identical to SEQ ID NO: 535081
  misc_feature: HIJSMM301EFBJA.26.23.C01.1.454.light.4.raw

SEQ ID NO: 546378 - DNA, 483 bp, Homo sapiens; identical to SEQ ID NO: 540738
  misc_feature: HIJSMM301A3O77.48.85.H08.1.454.light.4.raw

SEQ ID NO: 546379 - DNA, 454 bp, Homo sapiens; identical to SEQ ID NO: 536347
  misc_feature: HIJSMM301C68OG.19.86.H09.1.454.light.4.raw

SEQ ID NO: 546380 - DNA, 494 bp, Homo sapiens
  misc_feature: HIJSMM301B1AEX.53.5.A05.1.454.light.4.raw
cgcgtatacacacgaccggtgctcgatttagatagatagacagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctcagggatccctgagcgattctctggctccaactcagggacaacagtcacgttgaccatcggtggagtccaggcagaagacgaggctgactattactgtcaatcagcaggcagcagtggaactgtgcttttcggcggagggaccaagctgaccgtcctacgtcagcccaaggctgccccctcggtcactctgtt

SEQ ID NO: 546381 - DNA, 523 bp, Homo sapiens
  misc_feature: HIJSMM301B9XP0.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgtcggtccaacgggaccgaacggtaggaagtacgaaacgaaactacgtaggcgtgcaccactactcgtcttctatcttcccgtcccact

SEQ ID NO: 546382 - DNA, 503 bp, Homo sapiens
  misc_feature: HIJSMM301ERLBJ.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaaactagtggctgcacca

SEQ ID NO: 546383 - DNA, 497 bp, Homo sapiens; identical to SEQ ID NO: 534982
  misc_feature: HIJSMM301DGDXL.26.80.H03.1.454.light.4.raw

SEQ ID NO: 546384 - DNA, 491 bp, Homo sapiens; identical to SEQ ID NO: 535176
  misc_feature: HIJSMM301CBYQY.13.39.D06.1.454.light.4.raw

SEQ ID NO: 546385 - DNA, 497 bp, Homo sapiens; identical to SEQ ID NO: 538296
  misc_feature: HIJSMM301D2CDX.18.11.A11.1.454.light.4.raw

SEQ ID NO: 546386 - DNA, 481 bp, Homo sapiens; identical to SEQ ID NO: 535993
  misc_feature: HIJSMM301B33TH.21.25.C03.1.454.light.4.raw

SEQ ID NO: 546387 - DNA, 491 bp, Homo sapiens; identical to SEQ ID NO: 535294
  misc_feature: HIJSMM301D5R2V.16.68.G02.1.454.light.4.raw

SEQ ID NO: 546388 - DNA, 496 bp, Homo sapiens
  misc_feature: HIJSMM301CGR8X.3.71.G05.1.454.light.4.raw
agacgcactccacgaccggtgctcgatttagtgtcgtcgcaagagagaggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaccggccctcagggatcccagaccgattctctggctccagctcaggaaacacagcttccttgaccatcactggggctcaggcggaagatgaggctgactattactgtaactccgggccagcagtggtaacattgtgatattcggcggagggaccaaggtgaccgtcctacgtcagcccaaggctcgccccctcggtccactctcg

SEQ ID NO: 546389 - DNA, 507 bp, Homo sapiens
  misc_feature: HIJSMM301CVOA0.48.87.H10.1.454.light.4.raw
agtatacatacacgaccggtgctcgatttagcagtactgcgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaagggtggacatacaaaacgaactgtggctgcaccatctgtcttcatcttccccg

SEQ ID NO: 546390 - DNA, 447 bp, Homo sapiens; identical to SEQ ID NO: 535020
  misc_feature: HIJSMM301DVCZM.18.9.A09.1.454.light.4.raw

SEQ ID NO: 546391 - DNA, 494 bp, Homo sapiens; identical to SEQ ID NO: 535629
  misc_feature: HIJSMM301DV6ET.4.27.C05.1.454.light.4.raw

SEQ ID NO: 546392 - DNA, 494 bp, Homo sapiens; identical to SEQ ID NO: 545258
  misc_feature: HIJSMM301AUY2A.13.39.D06.1.454.light.4.raw

SEQ ID NO: 546393 - DNA, 510 bp, Homo sapiens
  misc_feature: HIJSMM301CYMBD.40.81.H04.1.454.light.4.raw
tctagcgactcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtctaggtcagcccaaggctgccccctcggtcactctgttcccta

SEQ ID NO: 546394 - DNA, 494 bp, Homo sapiens; identical to SEQ ID NO: 536221
  misc_feature: HIJSMM301ASYDZ.15.59.F04.1.454.light.4.raw

SEQ ID NO: 546395 - DNA, 447 bp, Homo sapiens; identical to SEQ ID NO: 541817
  misc_feature: HIJSMM301DORIK.18.9.A09.1.454.light.4.raw

SEQ ID NO: 546396 - DNA, 487 bp, Homo sapiens
  misc_feature: HIJSMM301DYPMG.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattaactgtcaacagtatcataatctccccactttcggccctggaccaaagtaggatatcaaacgaactgtggctgcaccatctgtt

SEQ ID NO: 546397 - DNA, 465 bp, Homo sapiens
  misc_feature: HIJSMM301ESMNK.52.8.A08.1.454.light.4.raw
cgcagtacgacacgaccggtgctcgatttagcatactctacaggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggaggatcaagcgaa

SEQ ID NO: 546398 - DNA, 489 bp, Homo sapiens; identical to SEQ ID NO: 536663
  misc_feature: HIJSMM301BLY69.16.72.G06.1.454.light.4.raw

SEQ ID NO: 546399 - DNA, 471 bp, Homo sapiens; identical to SEQ ID NO: 536384
  misc_feature: HIJSMM301AF68A.18.76.G10.1.454.light.4.raw

SEQ ID NO: 546400 - DNA, 525 bp, Homo sapiens
  misc_feature: HIJSMM301AGAD4.17.33.C11.1.454.light.4.raw
  modified_base (508)..(508): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggttggtgctgtgctattcggcggagggaccaagctgaccgtcttaaagtcagcccaaacggctgccccctccggtacgactccngtttcccgcccctcctt

SEQ ID NO: 546401 - DNA, 491 bp, Homo sapiens
  misc_feature: HIJSMM301CRAO9.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaacgaactgtgg

SEQ ID NO: 546402 - DNA, 487 bp, Homo sapiens; identical to SEQ ID NO: 545757
  misc_feature: HIJSMM301D7J49.49.3.A03.1.454.light.4.raw

SEQ ID NO: 546403 - DNA, 444 bp, Homo sapiens
  misc_feature: HIJSMM301EIH15.14.76.G10.1.454.light.4.raw
cgtctagtaccacgaccggtgctcgatttagtcactcatacagggtcctgggcccagtctgtgctgactcagccaccctcagcgtctgggccccccggcagagggtctccatctcttgttctggagtcacttccaacatcggaaataatgatgtgagctggtaccagcaggtcccaggaacggcccccaaacctcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccgccctcctcgtactagacg

SEQ ID NO: 546404 - DNA, 493 bp, Homo sapiens
  misc_feature: HIJSMM301DYPEP.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacccagacttacagtgcccccccgatccaccttcggccaagggacacgactggagattaaacgaactgtggctgcaccatctgtcttcat

SEQ ID NO: 546405 - DNA, 483 bp, Homo sapiens; identical to SEQ ID NO: 535480
  misc_feature: HIJSMM301B9OV4.46.26.C04.1.454.light.4.raw

SEQ ID NO: 546406 - DNA, 497 bp, Homo sapiens
  misc_feature: HIJSMM301ANGYJ.51.49.E05.1.454.light.4.raw
cgatcgtatacacgaccggtgctcgatttagagcgactagcaacacacaaagggggaggaactgctcagttaggagccagacggaaccatggaagccccagcgcagcttctcttcctcctgctactctggctcccagataccattggagagatagtgctgacgcagtctccagccaccctgtctgtgtctccaggggagagagtcaccctctcctgcagggcctctgagaatatagatatctacttggtctggtaccagcaaaacctggccagcctcccaggctcctcgtccatagtgcctccgccagggccgctggtgtcccagccaggttccgaggcagtcggtctgggacagagttcactctcaccattaccaacctgcagtctgaagattttggactttattactgtcagcagtataatgactggcctaggacgttcggccaagggaccgagggtggaaatcaagcggaactgtggctgcaccatctgtcttc

SEQ ID NO: 546407 - DNA, 477 bp, Homo sapiens
  misc_feature: HIJSMM301AXODM.13.76.G10.1.454.light.4.raw
tcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcggcgggacccaggctatggatgaggctgactattactgtcaggcgtgggacagcagcactgcccgctatgtcttcggaactgggaccaaggtcaccgtcctaagtcagcccaagga

SEQ ID NO: 546408 - DNA, 495 bp, Homo sapiens
  misc_feature: HIJSMM301ATLW9.41.28.C06.1.454.light.4.raw
tctatactatcacgaccggtgctcgatttagagctcacgtattgggtttgggggctgtgaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgacctcaggctcagtctctcctagtaattacgccagctggtaccagcagaccccaggccagcctccacgcatcctcatctactacacggacactcggtcttctggggtccctgatcgcttctctggctccatccttgggaacaaagctgccctcaccatcacgggggcccaggcagatgatgaatctgattattactgtgcgctatttgtgtataacgtcaattgggtctttggcggagggaccaagctgaccgtcctacgtcagcccaa

SEQ ID NO: 546409 - DNA, 494 bp, Homo sapiens; identical to SEQ ID NO: 545671
  misc_feature: HIJSMM301CE7WD.9.1.A01.1.454.light.4.raw

SEQ ID NO: 546410 - DNA, 419 bp, Homo sapiens; identical to SEQ ID NO: 541483
  misc_feature: HIJSMM301AX9DG.18.59.F04.1.454.light.4.raw

SEQ ID NO: 546411 - DNA, 498 bp, Homo sapiens
  misc_feature: HIJSMM301EJ7FU.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatt

SEQ ID NO: 546412 - DNA, 505 bp, Homo sapiens
  misc_feature: HIJSMM301CH6WQ.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 546413 - DNA, 473 bp, Homo sapiens; identical to SEQ ID NO: 537307
  misc_feature: HIJSMM301CB2F4.5.70.G04.1.454.light.4.raw

SEQ ID NO: 546414 - DNA, 486 bp, Homo sapiens; identical to SEQ ID NO: 535043
  misc_feature: HIJSMM301A3EK7.46.35.D02.1.454.light.4.raw

SEQ ID NO: 546415 - DNA, 495 bp, Homo sapiens; identical to SEQ ID NO: 535821
  misc_feature: HIJSMM301B1TVE.3.31.C09.1.454.light.4.raw

SEQ ID NO: 546416 - DNA, 490 bp, Homo sapiens; identical to SEQ ID NO: 535526
  misc_feature: HIJSMM301BV953.26.78.H01.1.454.light.4.raw

SEQ ID NO: 546417 - DNA, 498 bp, Homo sapiens
  misc_feature: HIJSMM301DSZLO.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttcggccaagggaccaaggagcaaatacaaacgaactgtggctgcaccatctgtcttcatcttcccgccat

SEQ ID NO: 546418 - DNA, 488 bp, Homo sapiens; identical to SEQ ID NO: 535861
  misc_feature: HIJSMM301CWRQ9.14.55.E11.1.454.light.4.raw

SEQ ID NO: 546419 - DNA, 495 bp, Homo sapiens; identical to SEQ ID NO: 535596
  misc_feature: HIJSMM301A1P6A.10.79.H02.1.454.light.4.raw

SEQ ID NO: 546420 - DNA, 474 bp, Homo sapiens
  misc_feature: HIJSMM301EE7S3.5.12.B01.1.454.light.4.raw
atcagacacgcacgaccggtgctcgatttagtagtgtagattccgcgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgt

SEQ ID NO: 546421 - DNA, 490 bp, Homo sapiens; identical to SEQ ID NO: 543909
  misc_feature: HIJSMM301BI8NM.14.55.E11.1.454.light.4.raw

SEQ ID NO: 546422 - DNA, 458 bp, Homo sapiens
  misc_feature: HIJSMM301C3GDX.22.28.C06.1.454.light.4.raw
  modified_base (441)..(441): a, c, t, g, unknown or other
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccncctcctcacgcgtatgt

SEQ ID NO: 546423 - DNA, 496 bp, Homo sapiens; identical to SEQ ID NO: 535109
  misc_feature: HIJSMM301EDGYA.16.78.H01.1.454.light.4.raw

SEQ ID NO: 546424 - DNA, 493 bp, Homo sapiens
  misc_feature: HIJSMM301BOJRR.15.67.G01.1.454.light.4.raw
tctacgtagccacgaccggtgctcgatttagagtatacatattgggtttgggggcgaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggccaggggaccgaaggtcggaaagtcaaacgaactagtggcgtgcacca

SEQ ID NO: 546425 - DNA, 434 bp, Homo sapiens; identical to SEQ ID NO: 536762
  misc_feature: HIJSMM301DBIRC.48.1.A01.1.454.light.4.raw

SEQ ID NO: 546426 - DNA, 484 bp, Homo sapiens; identical to SEQ ID NO: 535400
  misc_feature: HIJSMM301C1QV5.46.26.C04.1.454.light.4.raw

SEQ ID NO: 546427 - DNA, 487 bp, Homo sapiens; identical to SEQ ID NO: 541729
  misc_feature: HIJSMM301EEKIX.40.83.H06.1.454.light.4.raw

SEQ ID NO: 546428 - DNA, 501 bp, Homo sapiens
  misc_feature: HIJSMM301DTY2C.48.8.A08.1.454.light.4.raw
agtatacatacacgaccggtgctcgatttagcatactctacagggggaggaacccctcagttaggacccagagggaaccatggaagccccagctcagcttctcttcctcctgctactctggctcccaggttttaccggagagattgtgttgacacagtctccagtcaccctgtcattgtctccagggcaaagagccaccctctcctgcagggccaatgagagtattggcaacttcttaggctggtatcaacaaaagcctggccaggctcccaggctcctcatctatgatgcatcccatagggccagaggcatcccagccaggttcagtggcagtgggtctgggacagacttcactctcaccatcagcaccctagaacgtgaagattttgcagtttattactgtcagcaccgtaaaacctggcctctgagtggttttggccaggggaccaagctggacatcaaacgaactgtggctgcaccatctgtcttcatcttcccgcc

SEQ ID NO: 546429 - DNA, 484 bp, Homo sapiens; identical to SEQ ID NO: 535400
  misc_feature: HIJSMM301C646B.46.26.C04.1.454.light.4.raw

SEQ ID NO: 546430 - DNA, 492 bp, Homo sapiens
  misc_feature: HIJSMM301AD9BV.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaacgaactgtggctgcaccatctgtcttcatt

SEQ ID NO: 546431 - DNA, 490 bp, Homo sapiens
  misc_feature: HIJSMM301AHSPW.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaactgtggctgcaccatct

SEQ ID NO: 546432 - DNA, 492 bp, Homo sapiens
  misc_feature: HIJSMM301AGIB8.16.53.E09.1.454.light.4.raw
  modified_base (470)..(470): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacgctgaaaatcagcagagtggaggctgaggatgttggggtttattactgcatgcaagctctacaaactccttacactttgtccgagggaccganactggagatcaaacgaaactgt

SEQ ID NO: 546433 - DNA, 498 bp, Homo sapiens; identical to SEQ ID NO: 535974
  misc_feature: HIJSMM301D6GBZ.22.27.C05.1.454.light.4.raw

SEQ ID NO: 546434 - DNA, 496 bp, Homo sapiens; identical to SEQ ID NO: 535109
  misc_feature: HIJSMM301EU0TZ.16.78.H01.1.454.light.4.raw

SEQ ID NO: 546435 - DNA, 444 bp, Homo sapiens; identical to SEQ ID NO: 535192
  misc_feature: HIJSMM301BZ7W7.5.9.A09.1.454.light.4.raw

SEQ ID NO: 546436 - DNA, 493 bp, Homo sapiens
  misc_feature: HIJSMM301B9XCH.5.23.C01.1.454.light.4.raw
atcagacacgcacgaccggtgctcgatttagtacacgtgattagggattggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgataccctccgctcacttcggtcgagggaccaacggtggaggatcaaacgaaactagtggctgcaccactctcgtctt

SEQ ID NO: 546437 - DNA, 447 bp, Homo sapiens
  misc_feature: HIJSMM301BYA3G.18.9.A09.1.454.light.4.raw
  modified_base (412)..(412): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccnctgtcactctgttcccgccctcctccatactcgta

SEQ ID NO: 546438 - DNA, 491 bp, Homo sapiens
  misc_feature: HIJSMM301ASWGS.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcccgaagattttgcagtctattactgtcagcagtatggtcacgtcccaagaacttttggccaggggaccaagctggagatcaaacgaactgtggctgcaccatctgtt

SEQ ID NO: 546439 - DNA, 496 bp, Homo sapiens
  misc_feature: HIJSMM301EJIFO.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgacctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcacagcactctctatgtcttcggaactgggaccaaggtcaccgtcctaggtcagcccaagg

SEQ ID NO: 546440 - DNA, 506 bp, Homo sapiens; identical to SEQ ID NO: 537290
  misc_feature: HIJSMM301BQP33.13.11.A11.1.454.light.4.raw

SEQ ID NO: 546441 - DNA, 447 bp, Homo sapiens; identical to SEQ ID NO: 535020
  misc_feature: HIJSMM301B74LB.18.9.A09.1.454.light.4.raw

SEQ ID NO: 546442 - DNA, 456 bp, Homo sapiens
  misc_feature: HIJSMM301CTUFK.13.23.C01.1.454.light.4.raw
tcacgtactacacgaccggtgctcgatttagtacacgtgattagggattgggggccgttcctgggcccagtctgtgctgactcagccaccctcagcgtctgggacccccgggcagagggtcaccatctcttgttctgaaagcagctccaacaccggaactggtgatataaactggtaccagcagctcccaggaacggcccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtcctaggtcagcccaaggctgccccctcggtcactctgttcccacctcctctagtacgtga

SEQ ID NO: 546443 - DNA, 522 bp, Homo sapiens; identical to SEQ ID NO: 540226
  misc_feature: HIJSMM301C44M6.27.23.C01.1.454.light.4.raw

SEQ ID NO: 546444 - DNA, 498 bp, Homo sapiens
  misc_feature: HIJSMM301E26S6.52.1.A01.1.454.light.4.raw
  modified_base (486)..(486): a, c, t, g, unknown or other
cgcagtacgacacgaccggtgctcgatttagacgtctcatcaggggggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggtcccgcggtaccgactagtaggtagtattacaaaccgaaactacgtggtcgtgcnccaactctcgtt

SEQ ID NO: 546445 - DNA, 488 bp, Homo sapiens; identical to SEQ ID NO: 536861
  misc_feature: HIJSMM301CG037.12.88.H11.1.454.light.4.raw

SEQ ID NO: 546446 - DNA, 475 bp, Homo sapiens; identical to SEQ ID NO: 537714
  misc_feature: HIJSMM301A9CQM.7.81.H04.1.454.light.4.raw

SEQ ID NO: 546447 - DNA, 502 bp, Homo sapiens
  misc_feature: HIJSMM301B22MF.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggaccgttcggtccgaacgggaaccaacggtaggaaggtacaaacgaacctagtggctgcaccatctgtctt

SEQ ID NO: 546448 - DNA, 454 bp, Homo sapiens; identical to SEQ ID NO: 536943
  misc_feature: HIJSMM301CUGP7.19.86.H09.1.454.light.4.raw

SEQ ID NO: 546449 - DNA, 486 bp, Homo sapiens
  misc_feature: HIJSMM301ATPTU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttatcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaagggaccgaaggtggatatcagacgaa

SEQ ID NO: 546450 - DNA, 521 bp, Homo sapiens; identical to SEQ ID NO: 539946
  misc_feature: HIJSMM301DXQCI.5.27.C05.1.454.light.4.raw

SEQ ID NO: 546451 - DNA, 444 bp, Homo sapiens; identical to SEQ ID NO: 535594
  misc_feature: HIJSMM301EJDND.9.9.A09.1.454.light.4.raw

SEQ ID NO: 546452 - DNA, 490 bp, Homo sapiens; identical to SEQ ID NO: 544667
  misc_feature: HIJSMM301CH2NY.12.23.C01.1.454.light.4.raw

SEQ ID NO: 546453 - DNA, 491 bp, Homo sapiens
  misc_feature: HIJSMM301ERISG.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttgggtttattactgcatgcaagctctacaaactccttacacttttggtccaggggaccaagctggagatcaaacgaactgt

SEQ ID NO: 546454 - DNA, 498 bp, Homo sapiens; identical to SEQ ID NO: 536173
  misc_feature: HIJSMM301ECVJD.12.86.H09.1.454.light.4.raw

SEQ ID NO: 546455 - DNA, 447 bp, Homo sapiens; identical to SEQ ID NO: 535882
  misc_feature: HIJSMM301DK06C.18.9.A09.1.454.light.4.raw
  modified_base (429)..(429): a, c, t, g, unknown or other

SEQ ID NO: 546456 - DNA, 490 bp, Homo sapiens
  misc_feature: HIJSMM301DAMJI.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcgcggaggaccgaagtaggacatcaaacgaactagtggctgcaccatctc

SEQ ID NO: 546457 - DNA, 478 bp, Homo sapiens; identical to SEQ ID NO: 535129
  misc_feature: HIJSMM301BX9KF.11.11.A11.1.454.light.4.raw

SEQ ID NO: 546458 - DNA, 513 bp, Homo sapiens
  misc_feature: HIJSMM301A5IQR.48.13.B02.1.454.light.4.raw
agtatacatacacgaccggtgctcgatttagtctagcgacttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaagtaaaacgaaactagtggctgcaccatctgtcttcatt

SEQ ID NO: 546459 - DNA, 447 bp, Homo sapiens; identical to SEQ ID NO: 535201
  misc_feature: HIJSMM301EKVNT.18.9.A09.1.454.light.4.raw

SEQ ID NO: 546460 - DNA, 505 bp, Homo sapiens
  misc_feature: HIJSMM301CXXC4.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgttcccaccctcctcgctacgtaga

SEQ ID NO: 546461 - DNA, 504 bp, Homo sapiens; identical to SEQ ID NO: 538521
  misc_feature: HIJSMM301D0ZEZ.9.12.B01.1.454.light.4.raw

SEQ ID NO: 546462 - DNA, 493 bp, Homo sapiens; identical to SEQ ID NO: 535084
  misc_feature: HIJSMM301CTYB1.47.64.F09.1.454.light.4.raw

SEQ ID NO: 546463 - DNA, 486 bp, Homo sapiens; identical to SEQ ID NO: 535523
  misc_feature: HIJSMM301D0L74.22.73.G07.1.454.light.4.raw

SEQ ID NO: 546464 - DNA, 471 bp, Homo sapiens
  misc_feature: HIJSMM301EN8JG.13.76.G10.1.454.light.4.raw
tcacgtactacacgaccggtgctcgatttagtcactcatacaggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcag

SEQ ID NO: 546465 - DNA, 487 bp, Homo sapiens; identical to SEQ ID NO: 538190
  misc_feature: HIJSMM301B2M9N.47.70.G04.1.454.light.4.raw

SEQ ID NO: 546466 - DNA, 484 bp, Homo sapiens; identical to SEQ ID NO: 535211
  misc_feature: HIJSMM301D1SQL.47.46.E02.1.454.light.4.raw

SEQ ID NO: 546467 - DNA, 504 bp, Homo sapiens; identical to SEQ ID NO: 535561
  misc_feature: HIJSMM301BLXP4.4.57.F02.1.454.light.4.raw

SEQ ID NO: 546468 - DNA, 447 bp, Homo sapiens; identical to SEQ ID NO: 535201
  misc_feature: HIJSMM301AXIJE.18.9.A09.1.454.light.4.raw

SEQ ID NO: 546469 - DNA, 504 bp, Homo sapiens; identical to SEQ ID NO: 538035
  misc_feature: HIJSMM301AX4BK.5.68.G02.1.454.light.4.raw
  modified_base (492)..(492): a, c, t, g, unknown or other

SEQ ID NO: 546470 - DNA, 503 bp, Homo sapiens; identical to SEQ ID NO: 537226
  misc_feature: HIJSMM301DY3LK.19.85.H08.1.454.light.4.raw

SEQ ID NO: 546471 - DNA, 497 bp, Homo sapiens
  misc_feature: HIJSMM301DXV74.15.26.C04.1.454.light.4.raw
tctacgtagccacgaccggtgctcgatttagtctagcgactttgggtttggggtcagactcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaagcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggagtatcaaacgaaactgtggctgcaccatctgtcttcatt

SEQ ID NO: 546472 - DNA, 494 bp, Homo sapiens
  misc_feature: HIJSMM301D5FCS.16.53.E09.1.454.light.4.raw
  modified_base (471)..(471): a, c, t, g, unknown or other
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaanctggagatcaaacgaactgtggc

SEQ ID NO: 546473 - DNA, 470 bp, Homo sapiens; identical to SEQ ID NO: 535302
  misc_feature: HIJSMM301CK0Y2.13.76.G10.1.454.light.4.raw

SEQ ID NO: 546474 - DNA, 446 bp, Homo sapiens
  misc_feature: HIJSMM301ALJSC.5.9.A09.1.454.light.4.raw
atcagacacgcacgaccggtgctcgatttagcgagacgcgcaggggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatccactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 546475 - DNA, 454 bp, Homo sapiens; identical to SEQ ID NO: 536943
  misc_feature: HIJSMM301DLKHG.19.86.H09.1.454.light.4.raw

SEQ ID NO: 546476 - DNA, 501 bp, Homo sapiens; identical to SEQ ID NO: 536818
  misc_feature: HIJSMM301AHISW.12.82.H05.1.454.light.4.raw

SEQ ID NO: 546477 - DNA, 485 bp, Homo sapiens; identical to SEQ ID NO: 536576
  misc_feature: HIJSMM301BC1QW.46.35.D02.1.454.light.4.raw

SEQ ID NO: 546478 - DNA, 516 bp, Homo sapiens
  misc_feature: HIJSMM301A2GTR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaacgggaccgaaggtaggaaagtacaaacgaactagtggcgtgtcactctcgtcttctactcttcctccccg

SEQ ID NO: 546479 - DNA, 472 bp, Homo sapiens
  misc_feature: HIJSMM301BVM69.5.28.C06.1.454.light.4.raw
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggaggaccgaaggtggagatcgaacgaactgtgg

SEQ ID NO: 546480 - DNA, 485 bp, Homo sapiens; identical to SEQ ID NO: 535501
  misc_feature: HIJSMM301BJVO9.3.10.A10.1.454.light.4.raw

SEQ ID NO: 546481 - DNA, 486 bp, Homo sapiens; identical to SEQ ID NO: 537617
  misc_feature: HIJSMM301CF4HJ.10.53.E09.1.454.light.4.raw

SEQ ID NO: 546482 - DNA, 498 bp, Homo sapiens
  misc_feature: HIJSMM301CEOAO.11.67.G01.1.454.light.4.raw
cgagagataccacgaccggtgctcgatttagagtatacatattgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcactctcg

SEQ ID NO: 546483 - DNA, 482 bp, Homo sapiens
  misc_feature: HIJSMM301D5SEE.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcactttcggcgggggaccgaaggtggagatcaaacgaactgtggctgcacca

SEQ ID NO: 546484 - DNA, 507 bp, Homo sapiens
  misc_feature: HIJSMM301D57BV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaaactgtggctgcaccatctgtcttctatcttccccg

SEQ ID NO: 546485 - DNA, 404 bp, Homo sapiens; identical to SEQ ID NO: 535779
  misc_feature: HIJSMM301E3FQU.4.35.D02.1.454.light.4.raw

SEQ ID NO: 546486 - DNA, 494 bp, Homo sapiens; identical to SEQ ID NO: 534992
  misc_feature: HIJSMM301DOE2B.9.1.A01.1.454.light.4.raw

SEQ ID NO: 546487 - DNA, 520 bp, Homo sapiens; identical to SEQ ID NO: 535773
  misc_feature: HIJSMM301A545Q.41.19.B08.1.454.light.4.raw

SEQ ID NO: 546488 - DNA, 349 bp, Homo sapiens; identical to SEQ ID NO: 543377
  misc_feature: HIJSMM301CATY8.12.53.E09.1.454.light.4.raw

SEQ ID NO: 546489 - DNA, 508 bp, Homo sapiens
  misc_feature: HIJSMM301C7AZ9.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtcgacgaacggacgaggaagtaataacaaacacgtgtgctgaccacctatcgtcgttctactcttccccg

SEQ ID NO: 546490 - DNA, 483 bp, Homo sapiens; identical to SEQ ID NO: 536665
  misc_feature: HIJSMM301CFV8H.13.59.F04.1.454.light.4.raw

SEQ ID NO: 546491 - DNA, 486 bp, Homo sapiens; identical to SEQ ID NO: 535043
  misc_feature: HIJSMM301C28JP.46.35.D02.1.454.light.4.raw

SEQ ID NO: 546492 - DNA, 483 bp, Homo sapiens; identical to SEQ ID NO: 545893
  misc_feature: HIJSMM301CRFP5.3.38.D05.1.454.light.4.raw

SEQ ID NO: 546493 - DNA, 497 bp, Homo sapiens; identical to SEQ ID NO: 535740
  misc_feature: HIJSMM301EJYCA.3.71.G05.1.454.light.4.raw

SEQ ID NO: 546494 - DNA, 484 bp, Homo sapiens; identical to SEQ ID NO: 536162
  misc_feature: HIJSMM301EBJC2.13.59.F04.1.454.light.4.raw

SEQ ID NO: 546495 - DNA, 504 bp, Homo sapiens; identical to SEQ ID NO: 535077
  misc_feature: HIJSMM301DJRSS.8.28.C06.1.454.light.4.raw

SEQ ID NO: 546496 - DNA, 500 bp, Homo sapiens; identical to SEQ ID NO: 542309
  misc_feature: HIJSMM301CBSEU.12.86.H09.1.454.light.4.raw

SEQ ID NO: 546497 - DNA, 468 bp, Homo sapiens
  misc_feature: HIJSMM301E2G7E.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtcaacagagtttcactacccctctcacttcgtcggggacggacgaggtagagactaac

SEQ ID NO: 546498 - DNA, 510 bp, Homo sapiens
  misc_feature: HIJSMM301AR1GQ.47.55.E11.1.454.light.4.raw
agctcacgtacacgaccggtgctcgatttagcactcgcacgttgggtttggggagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaccccactgtcactctgttccca

SEQ ID NO: 546499 - DNA, 491 bp, Homo sapiens
  misc_feature: HIJSMM301A203J.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 546500 - DNA, 492 bp, Homo sapiens; identical to SEQ ID NO: 542642
  misc_feature: HIJSMM301DPYMZ.51.81.H04.1.454.light.4.raw

SEQ ID NO: 546501 - DNA, 517 bp, Homo sapiens
  misc_feature: HIJSMM301B2BJ4.43.81.H04.1.454.light.4.raw
tgtgagtagtcacgaccggtgctcgatttagtagtgtagattcgcgggtggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctcgccccctcggtcactctgttcccgccctcctcactact

SEQ ID NO: 546502 - DNA, 493 bp, Homo sapiens
  misc_feature: HIJSMM301EU6B0.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaacgaactgtggctgcaccatctgtcttcatt

SEQ ID NO: 546503 - DNA, 497 bp, Homo sapiens; identical to SEQ ID NO: 535764
  misc_feature: HIJSMM301BANDA.22.20.B09.1.454.light.4.raw

SEQ ID NO: 546504 - DNA, 511 bp, Homo sapiens
  misc_feature: HIJSMM301EYMJ4.15.86.H09.1.454.light.4.raw
tctacgtagccacgaccggtgctcgatttagtgctatagacttgggtttggggagacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgt

SEQ ID NO: 546505 - DNA, 494 bp, Homo sapiens; identical to SEQ ID NO: 535629
  misc_feature: HIJSMM301DPHA5.4.27.C05.1.454.light.4.raw

SEQ ID NO: 546506 - DNA, 447 bp, Homo sapiens; identical to SEQ ID NO: 535020
  misc_feature: HIJSMM301A2VAN.18.9.A09.1.454.light.4.raw

SEQ ID NO: 546507 - DNA, 491 bp, Homo sapiens
  misc_feature: HIJSMM301B2LI5.48.37.D04.1.454.light.4.raw
agtatacatacacgaccggtgctcgatttagtagcatactgttgggtttgggggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactacgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 546508 - DNA, 489 bp, Homo sapiens; identical to SEQ ID NO: 535180
  misc_feature: HIJSMM301AWAIQ.9.1.A01.1.454.light.4.raw

SEQ ID NO: 546509 - DNA, 458 bp, Homo sapiens
  misc_feature: HIJSMM301D47HY.51.1.A01.1.454.light.4.raw
cgatcgtatacacgaccggtgctcgatttagacgtctcatcaggggcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaaacgaa

SEQ ID NO: 546510 - DNA, 491 bp, Homo sapiens
  misc_feature: HIJSMM301BDX6X.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtaggaaatacaaacgaactgtggctgcaccatctgtcttcta

SEQ ID NO: 546511 - DNA, 482 bp, Homo sapiens; identical to SEQ ID NO: 536622
  misc_feature: HIJSMM301BU3L4.7.85.H08.1.454.light.4.raw

SEQ ID NO: 546512 - DNA, 506 bp, Homo sapiens
  misc_feature: HIJSMM301CNDYJ.48.71.G05.1.454.light.4.raw
agtatacatacacgaccggtgctcgatttagtgtcgtcgcaagagagaggggggagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccgccta

SEQ ID NO: 546513 - DNA, 504 bp, Homo sapiens
  misc_feature: HIJSMM301EO405.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 546514 - DNA, 443 bp, Homo sapiens
  misc_feature: HIJSMM301A1FIY.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagccaaggctgccccctcggtcactctgttcccaccctcctcgacacgcgag

SEQ ID NO: 546515 - DNA, 492 bp, Homo sapiens
  misc_feature: HIJSMM301AH6HK.16.68.G02.1.454.light.4.raw
tgtactactccacgaccggtgctcgatttagtcgatagtgaagggaaaggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaggtggagggtcaaacgaaactgtggctgcaccatctgtcttcat

SEQ ID NO: 546516 - DNA, 464 bp, Homo sapiens
  misc_feature: HIJSMM301CFPKD.10.40.D07.1.454.light.4.raw
catagtagtgcacgaccggtgctcgatttagtgatagagcgtaacaacagagggtccagggcccaatatgttctgacacagccgccctcagtgtccggggcccccgggcagcgggtcaccatctcctgcactgggaacaacttcaacatcggggcgagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctgccccctcggtcactctgttccccaccctcctccactactatg

SEQ ID NO: 546517 - DNA, 515 bp, Homo sapiens
  misc_feature: HIJSMM301E0QU5.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggcctgccccctcggtcactctgttcccatcctcct

SEQ ID NO: 546518 - DNA, 480 bp, Homo sapiens
  misc_feature: HIJSMM301CCOK7.4.39.D06.1.454.light.4.raw
agcactgtagcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcacc

SEQ ID NO: 546519 - DNA, 504 bp, Homo sapiens; identical to SEQ ID NO: 538940
  misc_feature: HIJSMM301AM48Z.2.35.D02.1.454.light.4.raw

SEQ ID NO: 546520 - DNA, 447 bp, Homo sapiens; identical to SEQ ID NO: 535020
  misc_feature: HIJSMM301C3GU2.18.9.A09.1.454.light.4.raw

SEQ ID NO: 546521 - DNA, 464 bp, Homo sapiens
  misc_feature: HIJSMM301E1A2Q.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcactactgtcaacagagtgacagcacgcctcacactttcggcggagggccaaggtggagatcaaacgaa

SEQ ID NO: 546522 - DNA, 497 bp, Homo sapiens; identical to SEQ ID NO: 545672
  misc_feature: HIJSMM301BH1LN.2.49.E05.1.454.light.4.raw

SEQ ID NO: 546523 - DNA, 489 bp, Homo sapiens; identical to SEQ ID NO: 535139
  misc_feature: HIJSMM301C0K2P.14.55.E11.1.454.light.4.raw

SEQ ID NO: 546524 - DNA, 493 bp, Homo sapiens; identical to SEQ ID NO: 535657
  misc_feature: HIJSMM301AUYDG.27.78.H01.1.454.light.4.raw

SEQ ID NO: 546525 - DNA, 495 bp, Homo sapiens
  misc_feature: HIJSMM301AJ8WP.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagtagcctgcaggctgaagatgtggcagtttattactgtcagcaatattatagtactcctccgaggctcactttcggcggagggaccaaggtggagatcaaacgaactgt

SEQ ID NO: 546526 - DNA, 490 bp, Homo sapiens; identical to SEQ ID NO: 536481
  misc_feature: HIJSMM301DOLE0.13.46.E02.1.454.light.4.raw

SEQ ID NO: 546527 - DNA, 447 bp, Homo sapiens; identical to SEQ ID NO: 535201
  misc_feature: HIJSMM301DTG7S.18.9.A09.1.454.light.4.raw

SEQ ID NO: 546528 - DNA, 444 bp, Homo sapiens
  misc_feature: HIJSMM301AWB0H.11.3.A03.1.454.light.4.raw
cgagagataccacgaccggtgctcgatttagagagcgtcacagggttccgtgggcccagtctgtgctgacgcagccgccctcagtgtctggggccccagggcagacggtcaccatctcctgcactggaaacagctccaacgtcggggcaggttatgatgttcactggtaccagcaccttccacaaacgagcccccaaactcctcatatatggtaacagcattcggccctcaggggtccctgaccgattctctggttaccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttccgccctcctcgtatctctcg

SEQ ID NO: 546529 - DNA, 491 bp, Homo sapiens
  misc_feature: HIJSMM301C26AZ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcaggtggatcaggcacagattttacactagaaaatcagcagagtggaggctgaggatgttgggctctattattgcatgcaagctctacaagtcccgctcactttcggcggacgggaccaagggtggagatacaaacgaact

SEQ ID NO: 546530 - DNA, 444 bp, Homo sapiens; identical to SEQ ID NO: 535594
  misc_feature: HIJSMM301EKV9G.9.9.A09.1.454.light.4.raw

SEQ ID NO: 546531 - DNA, 490 bp, Homo sapiens
  misc_feature: HIJSMM301BKPYB.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggtttccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctccacttcggtcggagggaccaaggtggagatcaagacgaactgtggctgcaccatctgttc

SEQ ID NO: 546532 - DNA, 474 bp, Homo sapiens
  misc_feature: HIJSMM301CEYQZ.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaactgtgctgcacc

SEQ ID NO: 546533 - DNA, 487 bp, Homo sapiens
  misc_feature: HIJSMM301CGI8F.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcacctttcggcggagggaccaaggtggagatcagacgaactgtggctgcaccatctgtctt

SEQ ID NO: 546534 - DNA, 482 bp, Homo sapiens
  misc_feature: HIJSMM301BZHR2.51.41.D08.1.454.light.4.raw
cgatcgtatacacgaccggtgctcgatttagtcacgcgagaaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcacc

SEQ ID NO: 546535 - DNA, 495 bp, Homo sapiens; identical to SEQ ID NO: 535821
  misc_feature: HIJSMM301DHLQR.3.31.C09.1.454.light.4.raw

SEQ ID NO: 546536 - DNA, 496 bp, Homo sapiens; identical to SEQ ID NO: 535109
  misc_feature: HIJSMM301CHU8A.16.78.H01.1.454.light.4.raw

SEQ ID NO: 546537 - DNA, 494 bp, Homo sapiens; identical to SEQ ID NO: 534994
  misc_feature: HIJSMM301DM3BR.27.78.H01.1.454.light.4.raw

SEQ ID NO: 546538 - DNA, 495 bp, Homo sapiens; identical to SEQ ID NO: 542299
  misc_feature: HIJSMM301C92TQ.22.86.H09.1.454.light.4.raw

SEQ ID NO: 546539 - DNA, 489 bp, Homo sapiens; identical to SEQ ID NO: 535139
  misc_feature: HIJSMM301AV65U.14.55.E11.1.454.light.4.raw

SEQ ID NO: 546540 - DNA, 512 bp, Homo sapiens
  misc_feature: HIJSMM301EZOCD.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtaggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgtccacgggaccgacacgtagaaatagagacgaaactacgtggcgtgcaccaactctgtcttctatcttcccgt

SEQ ID NO: 546541 - DNA, 479 bp, Homo sapiens; identical to SEQ ID NO: 536513
  misc_feature: HIJSMM301C2ATE.40.8.A08.1.454.light.4.raw

SEQ ID NO: 546542 - DNA, 491 bp, Homo sapiens; identical to SEQ ID NO: 544201
  misc_feature: HIJSMM301C8WE6.12.23.C01.1.454.light.4.raw

SEQ ID NO: 546543 - DNA, 444 bp, Homo sapiens; identical to SEQ ID NO: 535594
  misc_feature: HIJSMM301BAI5G.9.9.A09.1.454.light.4.raw

SEQ ID NO: 546544 - DNA, 502 bp, Homo sapiens
  misc_feature: HIJSMM301EJOH7.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatattttctatcctcgtggacgttcggccaagggaccagggtggaaatcagacgaactgtggctgcaccatctgtctt

SEQ ID NO: 546545 - DNA, 505 bp, Homo sapiens
  misc_feature: HIJSMM301BOSMN.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcgaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 546546 - DNA, 488 bp, Homo sapiens; identical to SEQ ID NO: 535990
  misc_feature: HIJSMM301EVTCF.11.28.C06.1.454.light.4.raw

SEQ ID NO: 546547 - DNA, 485 bp, Homo sapiens; identical to SEQ ID NO: 535363
  misc_feature: HIJSMM301C0IAX.17.26.C04.1.454.light.4.raw

SEQ ID NO: 546548 - DNA, 501 bp, Homo sapiens; identical to SEQ ID NO: 535746
  misc_feature: HIJSMM301DHY8I.18.11.A11.1.454.light.4.raw

SEQ ID NO: 546549 - DNA, 443 bp, Homo sapiens; identical to SEQ ID NO: 535284
  misc_feature: HIJSMM301C02Z9.5.9.A09.1.454.light.4.raw

SEQ ID NO: 546550 - DNA, 486 bp, Homo sapiens; identical to SEQ ID NO: 535917
  misc_feature: HIJSMM301CMOJY.3.10.A10.1.454.light.4.raw

SEQ ID NO: 546551 - DNA, 480 bp, Homo sapiens
  misc_feature: HIJSMM301EPMY4.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattatttgcatgcaagcaacacactggccgtacacttttggccaggggaccaagctggagatcaatcgaa

SEQ ID NO: 546552 - DNA, 487 bp, Homo sapiens; identical to SEQ ID NO: 538190
  misc_feature: HIJSMM301AY1UJ.47.70.G04.1.454.light.4.raw

SEQ ID NO: 546553 - DNA, 503 bp, Homo sapiens; identical to SEQ ID NO: 541454
  misc_feature: HIJSMM301C9LYS.9.12.B01.1.454.light.4.raw

SEQ ID NO: 546554 - DNA, 486 bp, Homo sapiens; identical to SEQ ID NO: 537127
  misc_feature: HIJSMM301BJX28.3.77.G11.1.454.light.4.raw

SEQ ID NO: 546555 - DNA, 508 bp, Homo sapiens
  misc_feature: HIJSMM301CDUER.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtccccccggacgtcgtccagggaccgacacgtagaaatagagacgaactagtggctgcaccactctgtcttctactcttcccgt

SEQ ID NO: 546556 - DNA, 506 bp, Homo sapiens
  misc_feature: HIJSMM301BZLVD.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgttgggtgtcggcggagggaccaagttgacgtcctaggtcagcccaaggctgccccctcggtcactctgtt

SEQ ID NO: 546557 - DNA, 499 bp, Homo sapiens
  misc_feature: HIJSMM301DZQLB.43.87.H10.1.454.light.4.raw
tgtgagtagtcacgaccggtgctcgatttagcagtactgcgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 546558 - DNA, 512 bp, Homo sapiens
  misc_feature: HIJSMM301AKD3M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaccgaacggtaggaaagtacaaacgaactagtggctgcaccatctgtcttcactcttccccg

SEQ ID NO: 546559 - DNA, 486 bp, Homo sapiens; identical to SEQ ID NO: 538568
  misc_feature: HIJSMM301EPGT2.47.38.D05.1.454.light.4.raw

SEQ ID NO: 546560 - DNA, 520 bp, Homo sapiens
  misc_feature: HIJSMM301A6LKR.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcgaggggtccctgaccgattctctggctaccaagtctggcacctcagccctccctggccatccgtgggctccagtctgaggatgagtctgatttattactgtgcaacatgggatgacagcctgaatgggtccgtattcgggcggaggaccaagcgtgaccgtcctcggtcacgacccaagggctccgtccccccg

SEQ ID NO: 546561 - DNA, 494 bp, Homo sapiens; identical to SEQ ID NO: 534994
  misc_feature: HIJSMM301AHL5I.27.78.H01.1.454.light.4.raw

SEQ ID NO: 546562 - DNA, 509 bp, Homo sapiens
  misc_feature: HIJSMM301EE1BL.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttctcaccct

SEQ ID NO: 546563 - DNA, 523 bp, Homo sapiens
  misc_feature: HIJSMM301DCM16.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggtcccgtcgggaccgaaggtaggaggaatcaaacgaaaactagttggcgtcgcaccaactctcgtcttcta

SEQ ID NO: 546564 - DNA, 504 bp, Homo sapiens; identical to SEQ ID NO: 538940
  misc_feature: HIJSMM301CZ71V.2.35.D02.1.454.light.4.raw

SEQ ID NO: 546565 - DNA, 500 bp, Homo sapiens
  misc_feature: HIJSMM301CMTWA.16.72.G06.1.454.light.4.raw
tgtactactccacgaccggtgctcgatttagctacgactgcaagggaaaggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcacttcgtcggagggaccgaagtaggaggatacaacgaaacgtaagtggcgtgcaccaactcttc

SEQ ID NO: 546566 - DNA, 513 bp, Homo sapiens
  misc_feature: HIJSMM301DJBLH.7.34.D01.1.454.light.4.raw
cgtgtctctacacgaccggtgctcgatttagatcgtctgtgttgggtttgggggggtctcaggaggcagcgctctcgggacgtctccaccatggcctgggctctgctattcctctccccctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactctcg

SEQ ID NO: 546567 - DNA, 499 bp, Homo sapiens
  misc_feature: HIJSMM301EIYVN.40.67.G01.1.454.light.4.raw
tctagcgactcacgaccggtgctcgatttagagtatacatattgggtttgggggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcgccagggaccaaggtggacgatcaagcgaactgtggctgcaccatctgtcttcatcttcccg

SEQ ID NO: 546568 - DNA, 521 bp, Homo sapiens; identical to SEQ ID NO: 538715
  misc_feature: HIJSMM301AMOHH.27.23.C01.1.454.light.4.raw

SEQ ID NO: 546569 - DNA, 518 bp, Homo sapiens; identical to SEQ ID NO: 545878
  misc_feature: HIJSMM301CF8PJ.41.25.C03.1.454.light.4.raw

SEQ ID NO: 546570 - DNA, 406 bp, Homo sapiens
  misc_feature: HIJSMM301AC80S.7.27.C05.1.454.light.4.raw
cgtgtctctacacgaccggtgctcgatttagacgcgatcgaagggtttggggccccagggcagagggtcaccatctcctgcactgggaacgcctccaacatcgggactttttatgatgcacactggtaccagcgccttccaggaacagcccccaccctcctcattcataataataacattcggccctcaggggtcccgtgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctgttcccgccctcctctagagacacg

SEQ ID NO: 546571 - DNA, 511 bp, Homo sapiens
  misc_feature: HIJSMM301D105B.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccacctcct

SEQ ID NO: 546572 - DNA, 503 bp, Homo sapiens; identical to SEQ ID NO: 536834
  misc_feature: HIJSMM301DKHM7.2.35.D02.1.454.light.4.raw

SEQ ID NO: 546573 - DNA, 497 bp, Homo sapiens
  misc_feature: HIJSMM301CQ8ZY.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcaggggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccccactgtcactc

SEQ ID NO: 546574 - DNA, 482 bp, Homo sapiens; identical to SEQ ID NO: 541033
  misc_feature: HIJSMM301DVAGX.4.27.C05.1.454.light.4.raw

SEQ ID NO: 546575 - DNA, 517 bp, Homo sapiens
  misc_feature: HIJSMM301DZOCC.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggtcattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgcctcctcacg

SEQ ID NO: 546576 - DNA, 494 bp, Homo sapiens; identical to SEQ ID NO: 534992
  misc_feature: HIJSMM301BNFYL.9.1.A01.1.454.light.4.raw

SEQ ID NO: 546577 - DNA, 487 bp, Homo sapiens; identical to SEQ ID NO: 546120
  misc_feature: HIJSMM301BCUUS.43.33.C11.1.454.light.4.raw

SEQ ID NO: 546578 - DNA, 453 bp, Homo sapiens
  misc_feature: HIJSMM301EFALX.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggcccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 546579 - DNA, 497 bp, Homo sapiens
  misc_feature: HIJSMM301CZ5GF.40.80.H03.1.454.light.4.raw
tctagcgactcacgaccggtgctcgatttagctgtgcgtcgaagggaaaggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttca

SEQ ID NO: 546580 - DNA, 490 bp, Homo sapiens; identical to SEQ ID NO: 536481
  misc_feature: HIJSMM301ESSY0.13.46.E02.1.454.light.4.raw

SEQ ID NO: 546581 - DNA, 491 bp, Homo sapiens; identical to SEQ ID NO: 535194
  misc_feature: HIJSMM301ESW40.26.78.H01.1.454.light.4.raw

SEQ ID NO: 546582 - DNA, 503 bp, Homo sapiens
  misc_feature: HIJSMM301C5HZE.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtgccgtttattactgtcagcaatattatggtactcctccgtggacgttcggccaagggaccaaggtggaaatcaaacgaactgtggctgcaccat

SEQ ID NO: 546583 - DNA, 474 bp, Homo sapiens; identical to SEQ ID NO: 538184
  misc_feature: HIJSMM301A0R6K.13.76.G10.1.454.light.4.raw

SEQ ID NO: 546584 - DNA, 502 bp, Homo sapiens
  misc_feature: HIJSMM301CAFBD.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccccggtcactctcg

SEQ ID NO: 546585 - DNA, 514 bp, Homo sapiens; identical to SEQ ID NO: 541418
  misc_feature: HIJSMM301BTGDH.17.33.C11.1.454.light.4.raw

SEQ ID NO: 546586 - DNA, 487 bp, Homo sapiens
  misc_feature: HIJSMM301DBCLF.3.10.A10.1.454.light.4.raw
agacgcactccacgaccggtgctcgatttagcgtcgatctcagggggtgggtccaggaggcagaactctgggtgtctcaccatggcctggatccctctacttctcccctcctcactctctgcacagactctgaggcctcctatggagctgacacagccaccctcggtgtcagtgtccccaggacagacggccaagatcaccttgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 546587 - DNA, 520 bp, Homo sapiens
  misc_feature: HIJSMM301C4PTA.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgttcggtgcttataattttgtcgcctggtaccaacaacaccccggcgaagcccccagaactcataatttactgatgtcactgatcggcctcagggtttctaatcgcttctctggctccaagtccggcgacacggcctccctgaccatctccggcctccaggcggaggacgagggtgattatttctgcagctcatttacaaccagcctacaccttgctcttcggaactgggaccacggtcatcgtcctaggtcagcccaaggccaacccatgtcactctgttcccgcctccta

SEQ ID NO: 546588 - DNA, 494 bp, Homo sapiens; identical to SEQ ID NO: 535629
  misc_feature: HIJSMM301DQ0CT.4.27.C05.1.454.light.4.raw

SEQ ID NO: 546589 - DNA, 510 bp, Homo sapiens; identical to SEQ ID NO: 540140
  misc_feature: HIJSMM301B0JRM.5.27.C05.1.454.light.4.raw

SEQ ID NO: 546590 - DNA, 524 bp, Homo sapiens
  misc_feature: HIJSMM301D42OX.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaaggaccgaacggtaggaagtacaaacgaactagtggcgtgcaccactctgtcttctactcttcccgtcccactctcgat

SEQ ID NO: 546591 - DNA, 506 bp, Homo sapiens
  misc_feature: HIJSMM301EL9A6.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtctaagtcagcccaaggctgccccctcggtcactctgttcccta

SEQ ID NO: 546592 - DNA, 447 bp, Homo sapiens; identical to SEQ ID NO: 535201
  misc_feature: HIJSMM301CJR9Y.18.9.A09.1.454.light.4.raw

SEQ ID NO: 546593 - DNA, 494 bp, Homo sapiens; identical to SEQ ID NO: 534992
  misc_feature: HIJSMM301CKLE2.9.1.A01.1.454.light.4.raw

SEQ ID NO: 546594 - DNA, 519 bp, Homo sapiens
  misc_feature: HIJSMM301DTGCF.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactgtcactctgttcccaccctcctcgacaccg

SEQ ID NO: 546595 - DNA, 517 bp, Homo sapiens; identical to SEQ ID NO: 537838
  misc_feature: HIJSMM301B0GSX.7.86.H09.1.454.light.4.raw

SEQ ID NO: 546596 - DNA, 500 bp, Homo sapiens
  misc_feature: HIJSMM301CA9DW.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccc

SEQ ID NO: 546597 - DNA, 492 bp, Homo sapiens; identical to SEQ ID NO: 536175
  misc_feature: HIJSMM301CIOB6.19.83.H06.1.454.light.4.raw

SEQ ID NO: 546598 - DNA, 487 bp, Homo sapiens
  misc_feature: HIJSMM301CDR5M.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggaccaaagtggatatcaaacgaactgtggctgcaccatctgtt

SEQ ID NO: 546599 - DNA, 501 bp, Homo sapiens; identical to SEQ ID NO: 535746
  misc_feature: HIJSMM301C5DEQ.18.11.A11.1.454.light.4.raw

SEQ ID NO: 546600 - DNA, 385 bp, Homo sapiens; identical to SEQ ID NO: 538634
  misc_feature: HIJSMM301EK0P8.12.41.D08.1.454.light.4.raw

SEQ ID NO: 546601 - DNA, 490 bp, Homo sapiens; identical to SEQ ID NO: 539741
  misc_feature: HIJSMM301C98OQ.21.47.E03.1.454.light.4.raw

SEQ ID NO: 546602 - DNA, 490 bp, Homo sapiens; identical to SEQ ID NO: 535234
  misc_feature: HIJSMM301BPKGY.17.21.B10.1.454.light.4.raw

SEQ ID NO: 546603 - DNA, 506 bp, Homo sapiens
  misc_feature: HIJSMM301B856K.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggcctacgggaccgaccggtacggtagtggtcgaacgacggaaccgtagtggtcgtgcaccaactcttcg

SEQ ID NO: 546604 - DNA, 447 bp, Homo sapiens; identical to SEQ ID NO: 535020
  misc_feature: HIJSMM301AXXPW.18.9.A09.1.454.light.4.raw

SEQ ID NO: 546605 - DNA, 501 bp, Homo sapiens
  misc_feature: HIJSMM301CP3D8.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctagaagattttgctagtttattactgtcagcagcgtagcaactggcctcggacgttcggccgaacgggaccgaaacgtaggacgatcaagacgaactgtggctgcaccactctgtt

SEQ ID NO: 546606 - DNA, 493 bp, Homo sapiens; identical to SEQ ID NO: 539456
  misc_feature: HIJSMM301AYBMO.10.79.H02.1.454.light.4.raw

SEQ ID NO: 546607 - DNA, 496 bp, Homo sapiens
  misc_feature: HIJSMM301CMYTR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacatgaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaaactgtggctgcaccatctgtcttcat

SEQ ID NO: 546608 - DNA, 496 bp, Homo sapiens
  misc_feature: HIJSMM301AJQYL.48.52.E08.1.454.light.4.raw
agtatacatacacgaccggtgctcgatttagtcgagctctcagagagaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 546609 - DNA, 354 bp, Homo sapiens; identical to SEQ ID NO: 535026
  misc_feature: HIJSMM301ATWSW.19.22.B11.1.454.light.4.raw

SEQ ID NO: 546610 - DNA, 490 bp, Homo sapiens
  misc_feature: HIJSMM301BJD3F.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaacgagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacaggagttcactctcaccatcagcagcctgcagtctgaagattttgctactttattactgtcagcaatataatgactggttctcgatcaccttcggccaagggacacgactggagattaaacgaactgtggctgcacccatctgt

SEQ ID NO: 546611 - DNA, 482 bp, Homo sapiens
  misc_feature: HIJSMM301DKJPJ.41.35.D02.1.454.light.4.raw
tctatactatcacgaccggtgctcgatttagcacacgatagttgggtttggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcacca

SEQ ID NO: 546612 - DNA, 489 bp, Homo sapiens
  misc_feature: HIJSMM301CT0FO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctc

SEQ ID NO: 546613 - DNA, 500 bp, Homo sapiens
  misc_feature: HIJSMM301AS1BM.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactgtggctgcaccatctgtcttcatcttccccg

SEQ ID NO: 546614 - DNA, 496 bp, Homo sapiens
  misc_feature: HIJSMM301AE6ZO.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggcccgtcgggacgtaaggtaggaggatcagacgaacgtagtggcgtgcgaccaactctgtcttcta

SEQ ID NO: 546615 - DNA, 500 bp, Homo sapiens
  misc_feature: HIJSMM301EEYWL.15.37.D04.1.454.light.4.raw
tctacgtagccacgaccggtgctcgatttagtagcatactgttgggtttgggggagtcagacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatattactaggtggttggcctggtatcagcagaaaccagggaaggcccctaagtccctcatcaagaaggcgtctactttagaagctggggtcccgtcaagattcagcgccggtggatctgggacagaattcactctcaccatcaacagcctggaacctgatgattttgcaacttattactgccaacactatgatactcacccgtacacttttggccagggaccaagctggagatcaaaggaactgtggctgcaccatctgtcttcatcttcccg

SEQ ID NO: 546616 - DNA, 518 bp, Homo sapiens
  misc_feature: HIJSMM301EDCBU.21.30.C08.1.454.light.4.raw
tcgtcgctcgcacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgccaaaaaattatgttttttggtaccagcagaagtcaggccaggcccctgtgttggtcatccatgaggacaggagacgaccctccgggatccctgagagattctctggctccaactcagggacggtggccacgttgattctcagtggggcccaggtggaggatgaagctgactactactgttactcagcagacagcagtggtcatcagggggcattcggcggagggaccaggttgaccgtcctaggtcagcccaaggctgccccctcggtcactctgttcccgccctcctccg

SEQ ID NO: 546617 - DNA, 471 bp, Homo sapiens
  misc_feature: HIJSMM301B6KJO.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaaggaccaaggtggaaatcaaacgaactgtgg

SEQ ID NO: 546618 - DNA, 501 bp, Homo sapiens
  misc_feature: HIJSMM301EE7SK.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaacgaactagtggctgcaccatctgtcttcat

SEQ ID NO: 546619 - DNA, 504 bp, Homo sapiens; identical to SEQ ID NO: 535561
  misc_feature: HIJSMM301D5RGD.4.57.F02.1.454.light.4.raw

SEQ ID NO: 546620 - DNA, 489 bp, Homo sapiens; identical to SEQ ID NO: 535386
  misc_feature: HIJSMM301CNU7B.12.51.E07.1.454.light.4.raw

SEQ ID NO: 546621 - DNA, 505 bp, Homo sapiens
  misc_feature: HIJSMM301DM436.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccaccctcctcg

SEQ ID NO: 546622 - DNA, 512 bp, Homo sapiens; identical to SEQ ID NO: 542788
  misc_feature: HIJSMM301BZEYA.17.33.C11.1.454.light.4.raw

SEQ ID NO: 546623 - DNA, 506 bp, Homo sapiens; identical to SEQ ID NO: 535404
  misc_feature: HIJSMM301BKYYE.10.88.H11.1.454.light.4.raw

SEQ ID NO: 546624 - DNA, 495 bp, Homo sapiens
  misc_feature: HIJSMM301BN02Z.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 546625 - DNA, 384 bp, Homo sapiens; identical to SEQ ID NO: 545295
  misc_feature: HIJSMM301A0Q81.49.27.C05.1.454.light.4.raw

SEQ ID NO: 546626 - DNA, 501 bp, Homo sapiens
  misc_feature: HIJSMM301A4QMM.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactaggaattaaaacgaactgtggctgcaccatctgtcttcatcttccccg

SEQ ID NO: 546627 - DNA, 479 bp, Homo sapiens
  misc_feature: HIJSMM301EBDYA.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcaccccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 546628 - DNA, 465 bp, Homo sapiens; identical to SEQ ID NO: 538589
  misc_feature: HIJSMM301DKQCB.12.39.D06.1.454.light.4.raw

SEQ ID NO: 546629 - DNA, 404 bp, Homo sapiens; identical to SEQ ID NO: 535530
  misc_feature: HIJSMM301E1O29.4.35.D02.1.454.light.4.raw

SEQ ID NO: 546630 - DNA, 515 bp, Homo sapiens; identical to SEQ ID NO: 538805
  misc_feature: HIJSMM301A245Z.14.19.B08.1.454.light.4.raw

SEQ ID NO: 546631 - DNA, 508 bp, Homo sapiens
  misc_feature: HIJSMM301A55ZU.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggcccgtgggaccaagtggatatcaaacgaactagtggctgcaccatctgtcttcta

SEQ ID NO: 546632 - DNA, 489 bp, Homo sapiens; identical to SEQ ID NO: 535139
  misc_feature: HIJSMM301BYZW5.14.55.E11.1.454.light.4.raw

SEQ ID NO: 546633 - DNA, 496 bp, Homo sapiens
  misc_feature: HIJSMM301AQ0CP.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggcccgccatggacgttcggccaagggaccaaggtggaaatgaaaggaactgtggctgcaccatctgtctt

SEQ ID NO: 546634 - DNA, 501 bp, Homo sapiens; identical to SEQ ID NO: 542349
  misc_feature: HIJSMM301DREY5.51.14.B03.1.454.light.4.raw

SEQ ID NO: 546635 - DNA, 483 bp, Homo sapiens; identical to SEQ ID NO: 535413
  misc_feature: HIJSMM301DZZVI.26.78.H01.1.454.light.4.raw

SEQ ID NO: 546636 - DNA, 486 bp, Homo sapiens
  misc_feature: HIJSMM301EQR0I.7.75.G09.1.454.light.4.raw
cgtgtctctacacgaccggtgctcgatttagtatagacatcagggggcaggagtcagacccagtcaggacacagcatggacatgagggtccccgctcagctcctgggactcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactattgtcagcaggctaacaggctgcccccaaccttcggccaggggacacgactggagattaaacgaactgtggctgcaccatctgtt

SEQ ID NO: 546637 - DNA, 514 bp, Homo sapiens; identical to SEQ ID NO: 538885
  misc_feature: HIJSMM301C0XRV.14.19.B08.1.454.light.4.raw

SEQ ID NO: 546638 - DNA, 493 bp, Homo sapiens
  misc_feature: HIJSMM301DK9GD.13.11.A11.1.454.light.4.raw
tcacgtactacacgaccggtgctcgatttagctacgactgcaggggagaagagctgctcagttaggacccagagggaaccatggaaaccccagcgcagcttctcttcctcctgctactctggctcccagataccaccggagaaattgtgttgacgcagtctccaggcatcgtgtctttgtctccaggggaaagagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcta

SEQ ID NO: 546639 - DNA, 460 bp, Homo sapiens; identical to SEQ ID NO: 536053
  misc_feature: HIJSMM301AMWBI.22.28.C06.1.454.light.4.raw

SEQ ID NO: 546640 - DNA, 502 bp, Homo sapiens; identical to SEQ ID NO: 536253
  misc_feature: HIJSMM301AT88A.21.22.B11.1.454.light.4.raw

SEQ ID NO: 546641 - DNA, 482 bp, Homo sapiens; identical to SEQ ID NO: 544159
  misc_feature: HIJSMM301C67PS.4.74.G08.1.454.light.4.raw

SEQ ID NO: 546642 - DNA, 521 bp, Homo sapiens; identical to SEQ ID NO: 539470
  misc_feature: HIJSMM301DAP7P.27.23.C01.1.454.light.4.raw

SEQ ID NO: 546643 - DNA, 484 bp, Homo sapiens
  misc_feature: HIJSMM301CML7Q.8.4.A04.1.454.light.4.raw
ctcgcgtgtccacgaccggtgctcgatttagagtagtgatcaggggggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaccaagctgaccgtcctaggtcagccccg

SEQ ID NO: 546644 - DNA, 505 bp, Homo sapiens; identical to SEQ ID NO: 535987
  misc_feature: HIJSMM301CHJAB.18.37.D04.1.454.light.4.raw

SEQ ID NO: 546645 - DNA, 484 bp, Homo sapiens
  misc_feature: HIJSMM301C8PXC.19.71.G05.1.454.light.4.raw
  modified_base (474)..(474): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttggccaaggaccaaggtgganatcagacgaa

SEQ ID NO: 546646 - DNA, 500 bp, Homo sapiens
  misc_feature: HIJSMM301EQKEA.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggaggccaaggtggagatcaaacgaactgtggctgcaccatctgtcttcatcttccccg

SEQ ID NO: 546647 - DNA, 513 bp, Homo sapiens; identical to SEQ ID NO: 535719
  misc_feature: HIJSMM301AU1Q6.17.33.C11.1.454.light.4.raw

SEQ ID NO: 546648 - DNA, 502 bp, Homo sapiens
  misc_feature: HIJSMM301DXIDD.48.27.C05.1.454.light.4.raw
agtatacatacacgaccggtgctcgatttagacgcgatcgaagggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccgcc

SEQ ID NO: 546649 - DNA, 504 bp, Homo sapiens
  misc_feature: HIJSMM301CCMVN.9.12.B01.1.454.light.4.raw
tgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaagtccggggtccctgaccgattcagtggcaggcgggtctgggacagatttcactctcaccatcagcagcctgcaggctgaagatgtggctagtttattactgtcaactagttttctcgggcgttcggccaagggaccaaggtggaaatacaaacgaactgtggctgcaccatctgtcttcta

SEQ ID NO: 546650 - DNA, 503 bp, Homo sapiens; identical to SEQ ID NO: 538884
  misc_feature: HIJSMM301CPH8M.27.78.H01.1.454.light.4.raw

SEQ ID NO: 546651 - DNA, 515 bp, Homo sapiens; identical to SEQ ID NO: 540368
  misc_feature: HIJSMM301AHTHS.16.88.H11.1.454.light.4.raw

SEQ ID NO: 546652 - DNA, 510 bp, Homo sapiens; identical to SEQ ID NO: 545590
  misc_feature: HIJSMM301DLPR8.7.34.D01.1.454.light.4.raw

SEQ ID NO: 546653 - DNA, 491 bp, Homo sapiens; identical to SEQ ID NO: 535194
  misc_feature: HIJSMM301DR8BV.26.78.H01.1.454.light.4.raw

SEQ ID NO: 546654 - DNA, 459 bp, Homo sapiens
  misc_feature: HIJSMM301DRAXJ.41.14.B03.1.454.light.4.raw
tctatactatcacgaccggtgctcgatttagtgtgagtagttccgcgggcacgaccggtgctcgatttagtgtgagtagttccgcgggcacgaccggtgctcgatttagacgcgatcgaagggtttggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 546655 - DNA, 495 bp, Homo sapiens
  misc_feature: HIJSMM301BOSYI.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaacgaactagtggctgcaccatctgtcttcatcttcccgt

SEQ ID NO: 546656 - DNA, 507 bp, Homo sapiens
  misc_feature: HIJSMM301E2Y7T.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgccaggacgaacggtaggaagtacaacgaactagtggcgtgcaccatctgtcttctactcttcccgtccact

SEQ ID NO: 546657 - DNA, 454 bp, Homo sapiens; identical to SEQ ID NO: 535005
  misc_feature: HIJSMM301BCKHI.19.86.H09.1.454.light.4.raw

SEQ ID NO: 546658 - DNA, 516 bp, Homo sapiens
  misc_feature: HIJSMM301BO65E.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcctacttcgttcggacgggacggaacgaggacggagtactacgacgaacgtacgtggtcgtcgtcgaccaactacttcgttcgttcctta

SEQ ID NO: 546659 - DNA, 492 bp, Homo sapiens; identical to SEQ ID NO: 537395
  misc_feature: HIJSMM301CW31B.16.73.G07.1.454.light.4.raw

SEQ ID NO: 546660 - DNA, 509 bp, Homo sapiens
  misc_feature: HIJSMM301BGM47.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaagggaccgaaggtaggaaatacaaacgaacctagtggctgcaccatctgtcttcatcttccccg

SEQ ID NO: 546661 - DNA, 478 bp, Homo sapiens; identical to SEQ ID NO: 535129
  misc_feature: HIJSMM301AVM8A.11.11.A11.1.454.light.4.raw

SEQ ID NO: 546662 - DNA, 485 bp, Homo sapiens; identical to SEQ ID NO: 542735
  misc_feature: HIJSMM301B849T.26.45.E01.1.454.light.4.raw

SEQ ID NO: 546663 - DNA, 486 bp, Homo sapiens
  misc_feature: HIJSMM301BCX8T.5.45.E01.1.454.light.4.raw
atcagacacgcacgaccggtgctcgatttagtgagtcagtaagggaaagggggcaggagtcagacccagtcaggacacagcatggacatgagggtccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaagttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcacca

SEQ ID NO: 546664 - DNA, 492 bp, Homo sapiens; identical to SEQ ID NO: 535126
  misc_feature: HIJSMM301CTTLW.18.11.A11.1.454.light.4.raw

SEQ ID NO: 546665 - DNA, 496 bp, Homo sapiens; identical to SEQ ID NO: 536248
  misc_feature: HIJSMM301A1DTH.22.27.C05.1.454.light.4.raw

SEQ ID NO: 546666 - DNA, 485 bp, Homo sapiens; identical to SEQ ID NO: 536040
  misc_feature: HIJSMM301CK4B8.15.1.A01.1.454.light.4.raw

SEQ ID NO: 546667 - DNA, 506 bp, Homo sapiens
  misc_feature: HIJSMM301D9E2R.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcgagggaccaagctgaccgtcttaagtcagcccaaggctgccccctggtcactctgttccca

SEQ ID NO: 546668 - DNA, 486 bp, Homo sapiens; identical to SEQ ID NO: 535043
  misc_feature: HIJSMM301B4RHC.46.35.D02.1.454.light.4.raw

SEQ ID NO: 546669 - DNA, 487 bp, Homo sapiens
  misc_feature: HIJSMM301CHUYH.52.27.C05.1.454.light.4.raw
cgcagtacgacacgaccggtgctcgatttagacgcgatcgaagggtttggggagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtgggtcccgtcaaggttcagtggccgtggatctgggacagatttcactctcaccatcagcagtctccaacctgaagattttgcaatttactactgtcaacagagtgacaatacccctcagactttcggccctggaccagagtggatatcaaacgaactgtggctgcaccatctgtcttcatt

SEQ ID NO: 546670 - DNA, 502 bp, Homo sapiens
  misc_feature: HIJSMM301DHKG4.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggaggaccaggctgaccgtcctgagtcagcccaaggctgccccccg

SEQ ID NO: 546671 - DNA, 486 bp, Homo sapiens
  misc_feature: HIJSMM301CRFUQ.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctctactttcggcggagggaccgagggtggagatcagacgaa

SEQ ID NO: 546672 - DNA, 447 bp, Homo sapiens; identical to SEQ ID NO: 535020
  misc_feature: HIJSMM301A8OFC.18.9.A09.1.454.light.4.raw

SEQ ID NO: 546673 - DNA, 497 bp, Homo sapiens
  misc_feature: HIJSMM301DNPQM.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtgctgcaccatctgtcttcat

SEQ ID NO: 546674 - DNA, 490 bp, Homo sapiens
  misc_feature: HIJSMM301DV92W.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccacgggaccgacggtcggagtgtcaagcgaactagtggctgcacca

SEQ ID NO: 546675 - DNA, 471 bp, Homo sapiens; identical to SEQ ID NO: 536384
  misc_feature: HIJSMM301CXISX.18.76.G10.1.454.light.4.raw

SEQ ID NO: 546676 - DNA, 453 bp, Homo sapiens; identical to SEQ ID NO: 535173
  misc_feature: HIJSMM301EQHW3.19.86.H09.1.454.light.4.raw

SEQ ID NO: 546677 - DNA, 491 bp, Homo sapiens; identical to SEQ ID NO: 535176
  misc_feature: HIJSMM301ATI6J.13.39.D06.1.454.light.4.raw

SEQ ID NO: 546678 - DNA, 488 bp, Homo sapiens; identical to SEQ ID NO: 545695
  misc_feature: HIJSMM301DD2R1.46.26.C04.1.454.light.4.raw

SEQ ID NO: 546679 - DNA, 516 bp, Homo sapiens
  misc_feature: HIJSMM301AKD0M.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaacgggaccgaacggtaggaaagtacaaacgaaactacgtggctgcaccaactctgtcttctatctttccccg

SEQ ID NO: 546680 - DNA, 518 bp, Homo sapiens; identical to SEQ ID NO: 544387
  misc_feature: HIJSMM301A7FDI.19.80.H03.1.454.light.4.raw

SEQ ID NO: 546681 - DNA, 494 bp, Homo sapiens
  misc_feature: HIJSMM301CUIJV.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctggtcagcccaaggcccaacccactcgtcta

SEQ ID NO: 546682 - DNA, 464 bp, Homo sapiens; identical to SEQ ID NO: 545784
  misc_feature: HIJSMM301BE8AO.4.23.C01.1.454.light.4.raw

SEQ ID NO: 546683 - DNA, 484 bp, Homo sapiens; identical to SEQ ID NO: 535441
  misc_feature: HIJSMM301BRP8N.26.60.F05.1.454.light.4.raw

SEQ ID NO: 546684 - DNA, 494 bp, Homo sapiens
  misc_feature: HIJSMM301BJ3A7.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcccactgagaatcagcagggtggaggctgaagatgtcggggtttattactgcatgcagggtacagtgtggccttcgctcgcattcggcggagggaccaaggtggagatcaaacgaactgtgg

SEQ ID NO: 546685 - DNA, 485 bp, Homo sapiens; identical to SEQ ID NO: 536799
  misc_feature: HIJSMM301CSCBV.19.71.G05.1.454.light.4.raw

SEQ ID NO: 546686 - DNA, 494 bp, Homo sapiens; identical to SEQ ID NO: 535276
  misc_feature: HIJSMM301AWBUB.16.6.A06.1.454.light.4.raw

SEQ ID NO: 546687 - DNA, 494 bp, Homo sapiens; identical to SEQ ID NO: 534992
  misc_feature: HIJSMM301CCDLA.9.1.A01.1.454.light.4.raw

SEQ ID NO: 546688 - DNA, 502 bp, Homo sapiens
  misc_feature: HIJSMM301BHBRV.41.26.C04.1.454.light.4.raw
tctatactatcacgaccggtgctcgatttagtctagcgactttgggtttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 546689 - DNA, 503 bp, Homo sapiens; identical to SEQ ID NO: 538884
  misc_feature: HIJSMM301BX0YN.27.78.H01.1.454.light.4.raw

SEQ ID NO: 546690 - DNA, 488 bp, Homo sapiens; identical to SEQ ID NO: 535990
  misc_feature: HIJSMM301D55RI.11.28.C06.1.454.light.4.raw

SEQ ID NO: 546691 - DNA, 484 bp, Homo sapiens
  misc_feature: HIJSMM301BIE21.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcacctcctaggtcagcccaaggccaa

SEQ ID NO: 546692 - DNA, 515 bp, Homo sapiens
  misc_feature: HIJSMM301A9QVQ.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaagtacaacgaaactagtggcgtgcaccatctcgtcttcta

SEQ ID NO: 546693 - DNA, 467 bp, Homo sapiens; identical to SEQ ID NO: 538403
  misc_feature: HIJSMM301AMTTA.41.48.E04.1.454.light.4.raw

SEQ ID NO: 546694 - DNA, 447 bp, Homo sapiens; identical to SEQ ID NO: 535201
  misc_feature: HIJSMM301CF7S1.18.9.A09.1.454.light.4.raw

SEQ ID NO: 546695 - DNA, 522 bp, Homo sapiens
  misc_feature: HIJSMM301D2D7K.10.86.H09.1.454.light.4.raw
catagtagtgcacgaccggtgctcgatttagtgctatagacttgggtttgggggctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcactttcccgggacagcccccaaactcctcatctatgaagattttacgcgaccctcagggattcctggccgattctctggctccaagtcaggcacctctgccaccctggacatcaccgggctccagaccggggacgaggcccgattattactgcgcaacttgggactccaacctgactgttggggctttcggcggagggactaagttgaccgtcctacgtcagcccaaggctgccccctcggtcact

SEQ ID NO: 546696 - DNA, 447 bp, Homo sapiens; identical to SEQ ID NO: 535020
  misc_feature: HIJSMM301EECFR.18.9.A09.1.454.light.4.raw

SEQ ID NO: 546697 - DNA, 502 bp, Homo sapiens
  misc_feature: HIJSMM301AVATV.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactg

SEQ ID NO: 546698 - DNA, 504 bp, Homo sapiens
  misc_feature: HIJSMM301A79SA.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactagtggctgcacactctgtcttcat

SEQ ID NO: 546699 - DNA, 488 bp, Homo sapiens; identical to SEQ ID NO: 537260
  misc_feature: HIJSMM301DH6UY.47.70.G04.1.454.light.4.raw

SEQ ID NO: 546700 - DNA, 480 bp, Homo sapiens
  misc_feature: HIJSMM301AGCM7.40.59.F04.1.454.light.4.raw
tctagcgactcacgaccggtgctcgatttagtacacacacttagggattggggggccgtcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggc

SEQ ID NO: 546701 - DNA, 501 bp, Homo sapiens; identical to SEQ ID NO: 540528
  misc_feature: HIJSMM301B0ZXP.11.31.C09.1.454.light.4.raw

SEQ ID NO: 546702 - DNA, 497 bp, Homo sapiens
  misc_feature: HIJSMM301DF81N.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaaggctgaccgtcctaggtcagcccaaggctgccccctcggtcactttgttcccgccctcctcgagtgcgtct

SEQ ID NO: 546703 - DNA, 485 bp, Homo sapiens; identical to SEQ ID NO: 535880
  misc_feature: HIJSMM301EAZRC.7.75.G09.1.454.light.4.raw

SEQ ID NO: 546704 - DNA, 487 bp, Homo sapiens; identical to SEQ ID NO: 537220
  misc_feature: HIJSMM301BRUNE.16.53.E09.1.454.light.4.raw

SEQ ID NO: 546705 - DNA, 504 bp, Homo sapiens
  misc_feature: HIJSMM301BEUX3.5.86.H09.1.454.light.4.raw
atcagacacgcacgaccggtgctcgatttagtgctatagacttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 546706 - DNA, 440 bp, Homo sapiens
  misc_feature: HIJSMM301D41K6.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgccctcctcgtatcctcg

SEQ ID NO: 546707 - DNA, 453 bp, Homo sapiens
  misc_feature: HIJSMM301C4XHQ.19.86.H09.1.454.light.4.raw
  modified_base (448)..(448): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgccccctcggtcactctgttcccacctcctccacgngagta

SEQ ID NO: 546708 - DNA, 482 bp, Homo sapiens
  misc_feature: HIJSMM301DC5IW.49.12.B01.1.454.light.4.raw
agtcgagagacacgaccggtgctcgatttagtagtgtagattccgcggggatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaatagggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcatcttcccgccatctgatt

SEQ ID NO: 546709 - DNA, 513 bp, Homo sapiens
  misc_feature: HIJSMM301BDS7T.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcgctacg

SEQ ID NO: 546710 - DNA, 497 bp, Homo sapiens; identical to SEQ ID NO: 536371
  misc_feature: HIJSMM301EB6JP.16.78.H01.1.454.light.4.raw

SEQ ID NO: 546711 - DNA, 484 bp, Homo sapiens
  misc_feature: HIJSMM301CAMY0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaaacgaactgtggctgcacat

SEQ ID NO: 546712 - DNA, 504 bp, Homo sapiens
  misc_feature: HIJSMM301DMSAY.48.70.G04.1.454.light.4.raw
agtatacatacacgaccggtgctcgatttagtgtagtgtgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaagggaccgaaggtggaaagtacaaacgaaactagtggcgtgcgacca

SEQ ID NO: 546713 - DNA, 493 bp, Homo sapiens
  misc_feature: HIJSMM301C9E31.13.67.G01.1.454.light.4.raw
tcacgtactacacgaccggtgctcgatttagagtatacatattgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 546714 - DNA, 463 bp, Homo sapiens; identical to SEQ ID NO: 535062
  misc_feature: HIJSMM301AHSVI.11.73.G07.1.454.light.4.raw

SEQ ID NO: 546715 - DNA, 492 bp, Homo sapiens
  misc_feature: HIJSMM301AQQII.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactccctgtatttttaagacatctgatttagaaagtggggtcccatcaaggttcagcggcagtgggtctgggacagaattcactctcaccatcagcagcctgcaacctgatgactttgctaacttattactgccaacagtataatggttatgaatccacttttggccaaggaccaagctggagatcaaacgaactgtggctgcaccta

SEQ ID NO: 546716 - DNA, 473 bp, Homo sapiens
  misc_feature: HIJSMM301BJI5H.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagaacg

SEQ ID NO: 546717 - DNA, 507 bp, Homo sapiens
  misc_feature: HIJSMM301BMZXK.14.55.E11.1.454.light.4.raw
  modified_base (425)..(425): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccncctctacgttcggacgggacggacgacggcgagtactcgacgaacgtaacgtggtcggctcgaccaactcttcgtcgttctt

SEQ ID NO: 546718 - DNA, 495 bp, Homo sapiens
  misc_feature: HIJSMM301BLO8V.3.10.A10.1.454.light.4.raw
agacgcactccacgaccggtgctcgatttagcgtcgatctcagggggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctgttaccaacagagacctggccagtctcccaggctcctcatgtttggtgcttccaccagggccactggtatcccagccaggttcagtggcagtgggtctgggacagagttcactctcaccatcagcagcctgcagtctgaagattttgcaatttatttctgtcagcagtacaataattggcctttgacgttcggccaagggaccaaggtggaaactaaacgaactgtggctgcaccatctgtcttcatcttcccgcc

SEQ ID NO: 546719 - DNA, 494 bp, Homo sapiens; identical to SEQ ID NO: 534992
  misc_feature: HIJSMM301C1OWN.9.1.A01.1.454.light.4.raw

SEQ ID NO: 546720 - DNA, 473 bp, Homo sapiens
  misc_feature: HIJSMM301BMSAL.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcggcctggactgaagtgcatatgaagagaactgtggctgca

SEQ ID NO: 546721 - DNA, 456 bp, Homo sapiens
  misc_feature: HIJSMM301BN12Z.40.76.G10.1.454.light.4.raw
  modified_base (454)..(454): a, c, t, g, unknown or other
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaagtggnga

SEQ ID NO: 546722 - DNA, 447 bp, Homo sapiens; identical to SEQ ID NO: 535020
  misc_feature: HIJSMM301DMDMX.18.9.A09.1.454.light.4.raw

SEQ ID NO: 546723 - DNA, 494 bp, Homo sapiens; identical to SEQ ID NO: 535629
  misc_feature: HIJSMM301BB74S.4.27.C05.1.454.light.4.raw

SEQ ID NO: 546724 - DNA, 325 bp, Homo sapiens
  misc_feature: HIJSMM301D8PQR.40.66.F11.1.454.light.4.raw
tctagcgactcacgaccggtgctcgatttagtcacgcgagaagggaaagggcccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagcccaaggctgccccctcggtcactctgttcccaccctcctcagtcgctaga

SEQ ID NO: 546725 - DNA, 489 bp, Homo sapiens; identical to SEQ ID NO: 540247
  misc_feature: HIJSMM301AW29F.48.75.G09.1.454.light.4.raw

SEQ ID NO: 546726 - DNA, 505 bp, Homo sapiens
  misc_feature: HIJSMM301BDQKH.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggccaagttgaccgtctaggtcagccaaggctgccccctcggtcactc

SEQ ID NO: 546727 - DNA, 496 bp, Homo sapiens; identical to SEQ ID NO: 536033
  misc_feature: HIJSMM301AJWDE.10.79.H02.1.454.light.4.raw

SEQ ID NO: 546728 - DNA, 500 bp, Homo sapiens; identical to SEQ ID NO: 540012
  misc_feature: HIJSMM301BAZT8.52.34.D01.1.454.light.4.raw

SEQ ID NO: 546729 - DNA, 513 bp, Homo sapiens; identical to SEQ ID NO: 535719
  misc_feature: HIJSMM301ECEVV.17.33.C11.1.454.light.4.raw

SEQ ID NO: 546730 - DNA, 482 bp, Homo sapiens; identical to SEQ ID NO: 535352
  misc_feature: HIJSMM301CS8C9.16.81.H04.1.454.light.4.raw

SEQ ID NO: 546731 - DNA, 525 bp, Homo sapiens
  misc_feature: HIJSMM301AP9IW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaaggtacgtaaacgaaactacgtaggcgtgcgaccaactctcgtcttctactcttcccgtcccact

SEQ ID NO: 546732 - DNA, 492 bp, Homo sapiens; identical to SEQ ID NO: 536733
  misc_feature: HIJSMM301DTXEK.40.11.A11.1.454.light.4.raw

SEQ ID NO: 546733 - DNA, 418 bp, Homo sapiens
  misc_feature: HIJSMM301CQKLA.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctgttccccgccctcctccatactcgta

SEQ ID NO: 546734 - DNA, 470 bp, Homo sapiens; identical to SEQ ID NO: 535302
  misc_feature: HIJSMM301EYX0C.13.76.G10.1.454.light.4.raw

SEQ ID NO: 546735 - DNA, 488 bp, Homo sapiens; identical to SEQ ID NO: 537260
  misc_feature: HIJSMM301D1OAD.47.70.G04.1.454.light.4.raw

SEQ ID NO: 546736 - DNA, 502 bp, Homo sapiens; identical to SEQ ID NO: 541971
  misc_feature: HIJSMM301A2AWZ.4.39.D06.1.454.light.4.raw

SEQ ID NO: 546737 - DNA, 517 bp, Homo sapiens
  misc_feature: HIJSMM301CDT47.41.25.C03.1.454.light.4.raw
tctatactatcacgaccggtgctcgatttagtagtgtagatttgggtttggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccca

SEQ ID NO: 546738 - DNA, 492 bp, Homo sapiens; identical to SEQ ID NO: 544236
  misc_feature: HIJSMM301CJ05R.12.23.C01.1.454.light.4.raw

SEQ ID NO: 546739 - DNA, 486 bp, Homo sapiens; identical to SEQ ID NO: 535290
  misc_feature: HIJSMM301BYRKQ.3.12.B01.1.454.light.4.raw

SEQ ID NO: 546740 - DNA, 500 bp, Homo sapiens
  misc_feature: HIJSMM301DYYT7.43.34.D01.1.454.light.4.raw
tgtgagtagtcacgaccggtgctcgatttagatcgtctgtgttgggtttgggggggcgacaagaggcagcgctctcgggacggtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccca

SEQ ID NO: 546741 - DNA, 494 bp, Homo sapiens; identical to SEQ ID NO: 534994
  misc_feature: HIJSMM301A3SQY.27.78.H01.1.454.light.4.raw

SEQ ID NO: 546742 - DNA, 497 bp, Homo sapiens
  misc_feature: HIJSMM301B5961.27.78.H01.1.454.light.4.raw
agcgtcgtctcacgaccggtgctcgatttagtgtgagtagtttgggtttgggggcgatgagcaaaactagacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacgacgactggagattaaacgaactgtggctgcaccaatctgtt

SEQ ID NO: 546743 - DNA, 508 bp, Homo sapiens
  misc_feature: HIJSMM301EICRI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaatacaaacgaaactcgtggctgcaccatctgtcttcatcttccccg

SEQ ID NO: 546744 - DNA, 523 bp, Homo sapiens
  misc_feature: HIJSMM301CE1JS.27.23.C01.1.454.light.4.raw
agcgtcgtctcacgaccggtgctcgatttagtacacgtgattagggattggggggggtctcaggaggcagcgctctcgggacccgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 546745 - DNA, 491 bp, Homo sapiens
  misc_feature: HIJSMM301EP9IF.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaaatagttaacccgctcagtttcggcggagggaccaaaggtggagatcaaacgaactgtggctgcaccatctgtcttca

SEQ ID NO: 546746 - DNA, 490 bp, Homo sapiens; identical to SEQ ID NO: 535526
  misc_feature: HIJSMM301EGV2U.26.78.H01.1.454.light.4.raw

SEQ ID NO: 546747 - DNA, 495 bp, Homo sapiens
  misc_feature: HIJSMM301C3KYX.48.86.H09.1.454.light.4.raw
agtatacatacacgaccggtgctcgatttagtgctatagacttgggtttgggggaagacaatgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgata

SEQ ID NO: 546748 - DNA, 497 bp, Homo sapiens
  misc_feature: HIJSMM301B07OX.43.37.D04.1.454.light.4.raw
tgtgagtagtcacgaccggtgctcgatttagtagcatactgttgggtttgggggcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcagcccaa

SEQ ID NO: 546749 - DNA, 502 bp, Homo sapiens
  misc_feature: HIJSMM301DJ6GW.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaaggtggatatcaaacgaactgtggctgcaccatct

SEQ ID NO: 546750 - DNA, 483 bp, Homo sapiens
  misc_feature: HIJSMM301DDNUP.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctggtcactctgttcccgcctcctcgctacgtaga

SEQ ID NO: 546751 - DNA, 504 bp, Homo sapiens; identical to SEQ ID NO: 535561
  misc_feature: HIJSMM301DM7KB.4.57.F02.1.454.light.4.raw

SEQ ID NO: 546752 - DNA, 487 bp, Homo sapiens; identical to SEQ ID NO: 536206
  misc_feature: HIJSMM301EV8U8.47.38.D05.1.454.light.4.raw

SEQ ID NO: 546753 - DNA, 515 bp, Homo sapiens
  misc_feature: HIJSMM301C8DPW.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccacctcctcgacacgcg

SEQ ID NO: 546754 - DNA, 502 bp, Homo sapiens; identical to SEQ ID NO: 540900
  misc_feature: HIJSMM301CJU2X.52.34.D01.1.454.light.4.raw

SEQ ID NO: 546755 - DNA, 484 bp, Homo sapiens; identical to SEQ ID NO: 535211
  misc_feature: HIJSMM301CQ0W1.47.46.E02.1.454.light.4.raw

SEQ ID NO: 546756 - DNA, 472 bp, Homo sapiens; identical to SEQ ID NO: 540638
  misc_feature: HIJSMM301EE842.8.67.G01.1.454.light.4.raw

SEQ ID NO: 546757 - DNA, 494 bp, Homo sapiens
  misc_feature: HIJSMM301CNMRQ.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctcggtcactctgttcccaccctctcacgcg

SEQ ID NO: 546758 - DNA, 488 bp, Homo sapiens; identical to SEQ ID NO: 541868
  misc_feature: HIJSMM301CHLPP.14.55.E11.1.454.light.4.raw

SEQ ID NO: 546759 - DNA, 484 bp, Homo sapiens; identical to SEQ ID NO: 535400
  misc_feature: HIJSMM301D7NDF.46.26.C04.1.454.light.4.raw

SEQ ID NO: 546760 - DNA, 507 bp, Homo sapiens; identical to SEQ ID NO: 536666
  misc_feature: HIJSMM301A0P1T.11.57.F02.1.454.light.4.raw

SEQ ID NO: 546761 - DNA, 497 bp, Homo sapiens; identical to SEQ ID NO: 536371
  misc_feature: HIJSMM301CE2GR.16.78.H01.1.454.light.4.raw

SEQ ID NO: 546762 - DNA, 493 bp, Homo sapiens
  misc_feature: HIJSMM301DELA2.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcgggggaccaagctggagatcaaccgaactgtggctgcaccatctgt

SEQ ID NO: 546763 - DNA, 481 bp, Homo sapiens
  misc_feature: HIJSMM301CQ6TR.48.27.C05.1.454.light.4.raw
agtatacatacacgaccggtgctcgatttagacgcgatcgaagggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaagtcaaacgaactgtggctgcacc

SEQ ID NO: 546764 - DNA, 505 bp, Homo sapiens
  misc_feature: HIJSMM301D8Z7S.41.55.E11.1.454.light.4.raw
tctatactatcacgaccggtgctcgatttagcactcgcacgttgggtttggggctgggcctcaggaagcagcatcggaggtgcctcagccatggcgtggatccctctcttcctcggcgtccttgcttcctgcacagtttccgtggcctcctcggaattgactcaggcaccctcagtgtccgtgtctccaggacagacagccagaatcacctgctctggagacacgttgggggagacatttgcttcctggtatcaacagaggccaggccagtcccctatcctggtcatctttcaggatgacaaacggccctctggcatccctgaacgcttctctggttccaggtcaggaaacagagccactctaaccatcaccgagacccaggctgtcgatgaggctgactattactgtcaggcctgggacagaaacactggcatattcggcggagggaccaagctgaccgtcctacgtcagcccaaggcctgccccctcggtcactctgttcccg

SEQ ID NO: 546765 - DNA, 447 bp, Homo sapiens; identical to SEQ ID NO: 535020
  misc_feature: HIJSMM301AYC93.18.9.A09.1.454.light.4.raw

SEQ ID NO: 546766 - DNA, 497 bp, Homo sapiens; identical to SEQ ID NO: 535664
  misc_feature: HIJSMM301DFR5A.22.14.B03.1.454.light.4.raw

SEQ ID NO: 546767 - DNA, 515 bp, Homo sapiens; identical to SEQ ID NO: 536247
  misc_feature: HIJSMM301C4CRM.14.19.B08.1.454.light.4.raw

SEQ ID NO: 546768 - DNA, 489 bp, Homo sapiens
  misc_feature: HIJSMM301DE1KT.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatcaaacgaaa

SEQ ID NO: 546769 - DNA, 518 bp, Homo sapiens
  misc_feature: HIJSMM301BRVAQ.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcaacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaacccactgtcactctgttcccaccctcctccgtgt

SEQ ID NO: 546770 - DNA, 501 bp, Homo sapiens
  misc_feature: HIJSMM301CPLEQ.4.71.G05.1.454.light.4.raw
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgacgtcctaggtcagcccaaggctgccccctcggtcactctgtt

SEQ ID NO: 546771 - DNA, 480 bp, Homo sapiens; identical to SEQ ID NO: 535291
  misc_feature: HIJSMM301D096Z.22.59.F04.1.454.light.4.raw

SEQ ID NO: 546772 - DNA, 490 bp, Homo sapiens
  misc_feature: HIJSMM301AH93L.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcaaggttcagcggcagtggatctgggacagatttcactctcgccatcagcagcctgcagactgaagattttgcaacttatttttgtcaacaggctaacactttccccctcactttcggcggagggaccaaggtggagatcaagcgaactgtggctgcaccatctgtctt

SEQ ID NO: 546773 - DNA, 509 bp, Homo sapiens
  misc_feature: HIJSMM301DBVCJ.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccaatctgtcttcta

SEQ ID NO: 546774 - DNA, 454 bp, Homo sapiens; identical to SEQ ID NO: 535005
  misc_feature: HIJSMM301DSN6F.19.86.H09.1.454.light.4.raw

SEQ ID NO: 546775 - DNA, 495 bp, Homo sapiens
  misc_feature: HIJSMM301AFYET.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtggagatcaaacgaact

SEQ ID NO: 546776 - DNA, 492 bp, Homo sapiens; identical to SEQ ID NO: 537246
  misc_feature: HIJSMM301BCDLB.43.28.C06.1.454.light.4.raw

SEQ ID NO: 546777 - DNA, 484 bp, Homo sapiens
  misc_feature: HIJSMM301CYC1K.48.77.G11.1.454.light.4.raw
agtatacatacacgaccggtgctcgatttagctagtcactcaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcggaccaaggtggagatcaaacgaa

SEQ ID NO: 546778 - DNA, 460 bp, Homo sapiens; identical to SEQ ID NO: 537107
  misc_feature: HIJSMM301CKU39.22.28.C06.1.454.light.4.raw

SEQ ID NO: 546779 - DNA, 496 bp, Homo sapiens
  misc_feature: HIJSMM301CP4XI.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctcacggtacacttttggccaggggaccaagctggagatcaaacgaactgtggctgcaccatctgt

SEQ ID NO: 546780 - DNA, 493 bp, Homo sapiens
  misc_feature: HIJSMM301A33RW.27.78.H01.1.454.light.4.raw
  modified_base (361)..(361): a, c, t, g, unknown or other
  modified_base (426)..(426): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactgggtaccagcagaagccaggtcagtctccaaagctcctcatcaagtatgcttcccagtccttctcaggggtcccctcgaggttcagtggcagtggatctgggacacatttcaccctnaccatcaatagcctggaagctgaagatgctgcaacttatactgtcatcagagtactactttaccncaagtgatccacttcggccaagggacacgactgagattaaacgaactgtggctgcaccatctgtctt

SEQ ID NO: 546781 - DNA, 497 bp, Homo sapiens
  misc_feature: HIJSMM301D0D7Q.43.28.C06.1.454.light.4.raw
tgtgagtagtcacgaccggtgctcgatttagagctcacgtattgggtttgggggatcaggactcctcagttcaccttctcacaatgaggctccctgctcagctcctggggctgctaatgctctgggtcccaggattaagtggcgaggttgtgatgactcagtctccactctccctgtccgtcacccttggacagccggcctccatctcctgcaggtctagtgaaggcctcctacacagtactggaggcacctacttgagttggtttcaccagaggccaggccaatctccaaggcgtctgatttataagatttctatccgggactctggggtcccagacaggttcagcggcagtgggtcagacactgacttcacactgagaatcagcagggtggaggctgaggatgttggaatttattactgcatgcaatcttcacactggcctccgtacacttttggccaggggaccaagctggagatcaaacgaactgtggctgca

SEQ ID NO: 546782 - DNA, 486 bp, Homo sapiens; identical to SEQ ID NO: 535043
  misc_feature: HIJSMM301DECLQ.46.35.D02.1.454.light.4.raw

SEQ ID NO: 546783 - DNA, 446 bp, Homo sapiens; identical to SEQ ID NO: 537066
  misc_feature: HIJSMM301EMH4K.18.9.A09.1.454.light.4.raw

SEQ ID NO: 546784 - DNA, 520 bp, Homo sapiens
  misc_feature: HIJSMM301ECPVF.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttattgctgtcaataagcggccctcaggggtcccgtcgatcgcttctctggctccaagtctggcaacacggcctccctcgaccatctctgggctccaggctgaagatgaggctgattattactgctgctcatttgcaggcgcctacacttgggtggttcggcggagggaccaagctcgaccggtccctaggtcacgccccaaggctcgcccccctccggtacacctcttcgttccccgccccctccctacc

SEQ ID NO: 546785 - DNA, 495 bp, Homo sapiens
  misc_feature: HIJSMM301BCWRC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctgactccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggtcggagggaccgaaggacggagatcagacgaactagtggcgtgcaccactctgtcttcta

SEQ ID NO: 546786 - DNA, 487 bp, Homo sapiens
  misc_feature: HIJSMM301DHHF7.49.64.F09.1.454.light.4.raw
agtcgagagacacgaccggtgctcgatttagcgcgtatacaagggggcaggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaaggtggaggatcaaaagaactgtggctgcaccatctgtt

SEQ ID NO: 546787 - DNA, 490 bp, Homo sapiens; identical to SEQ ID NO: 535234
  misc_feature: HIJSMM301EPZFB.17.21.B10.1.454.light.4.raw

SEQ ID NO: 546788 - DNA, 454 bp, Homo sapiens; identical to SEQ ID NO: 536846
  misc_feature: HIJSMM301EWTX3.18.78.H01.1.454.light.4.raw

SEQ ID NO: 546789 - DNA, 490 bp, Homo sapiens; identical to SEQ ID NO: 544667
  misc_feature: HIJSMM301CUVDW.12.23.C01.1.454.light.4.raw

SEQ ID NO: 546790 - DNA, 463 bp, Homo sapiens; identical to SEQ ID NO: 535062
  misc_feature: HIJSMM301AS1ND.11.73.G07.1.454.light.4.raw

SEQ ID NO: 546791 - DNA, 502 bp, Homo sapiens
  misc_feature: HIJSMM301DWN8D.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgactgtggctgcaccatctgtcttcatcttccccg

SEQ ID NO: 546792 - DNA, 507 bp, Homo sapiens; identical to SEQ ID NO: 541461
  misc_feature: HIJSMM301DAJ1B.11.57.F02.1.454.light.4.raw

SEQ ID NO: 546793 - DNA, 494 bp, Homo sapiens
  misc_feature: HIJSMM301AIT4U.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagattaaacgaaactgtggctgcaccatctgtctt

SEQ ID NO: 546794 - DNA, 497 bp, Homo sapiens; identical to SEQ ID NO: 535886
  misc_feature: HIJSMM301BAURZ.8.10.A10.1.454.light.4.raw

SEQ ID NO: 546795 - DNA, 507 bp, Homo sapiens
  misc_feature: HIJSMM301EFPR5.5.60.F05.1.454.light.4.raw
atcagacacgcacgaccggtgctcgatttagtacgtcatcagggaaagggtagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtcctcggtcagcccaagctgccccctc

SEQ ID NO: 546796 - DNA, 487 bp, Homo sapiens; identical to SEQ ID NO: 540841
  misc_feature: HIJSMM301DRSZR.4.33.C11.1.454.light.4.raw

SEQ ID NO: 546797 - DNA, 507 bp, Homo sapiens
  misc_feature: HIJSMM301AQ5B5.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcactttcgttagggtggtatcaacataaatccggccaggctcccaggctcctcatctttgatgctttcaacagggcccctggcgtcccaggcaggttcagtggcagtgggtctgggacaggacttcactctcaccatcagcagcctagagcctgaagattttgcagtttattactgtcagcagcgtgccactttcggcggaggtgccactttcggtcggagggaccgaaataagaggtcaacgaaactgtggctgcaccatctgtcttcatt

SEQ ID NO: 546798 - DNA, 494 bp, Homo sapiens; identical to SEQ ID NO: 534994
  misc_feature: HIJSMM301CJOKI.27.78.H01.1.454.light.4.raw

SEQ ID NO: 546799 - DNA, 521 bp, Homo sapiens; identical to SEQ ID NO: 540400
  misc_feature: HIJSMM301BMHRC.27.23.C01.1.454.light.4.raw

SEQ ID NO: 546800 - DNA, 486 bp, Homo sapiens; identical to SEQ ID NO: 535043
  misc_feature: HIJSMM301DE79D.46.35.D02.1.454.light.4.raw

SEQ ID NO: 546801 - DNA, 497 bp, Homo sapiens
  misc_feature: HIJSMM301BET4D.3.3.A03.1.454.light.4.raw
agacgcactccacgaccggtgctcgatttagagagcgtcacagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctgaagattttgcagtctattattgtcaacagcgtggcaactggccctcgtggacgttcggccaacgggaccgaaggtggaaatcaaccgaaacctgtggctgcaccatctgtcttctat

SEQ ID NO: 546802 - DNA, 465 bp, Homo sapiens; identical to SEQ ID NO: 538589
  misc_feature: HIJSMM301D2IBW.12.39.D06.1.454.light.4.raw

SEQ ID NO: 546803 - DNA, 523 bp, Homo sapiens
  misc_feature: HIJSMM301BYLXW.16.59.F04.1.454.light.4.raw
tgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgagtagtaca

SEQ ID NO: 546804 - DNA, 484 bp, Homo sapiens
  misc_feature: HIJSMM301CLR1Q.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactcccccaccatcagcacgccttagcctggtaccagcacaagtcagggcagcctcctaagttgcttcttttactggacttcgatccgcgcatctggggtccctgaccgattcatgggcagcggctctgggacagacttcgctctcaccatcaacagcctccaggctgaggatgcggcgtttattattgtcaacaatatttagtgctccgtacacttttggccagggaccaagttggagatcaaacgaact

SEQ ID NO: 546805 - DNA, 483 bp, Homo sapiens; identical to SEQ ID NO: 539848
  misc_feature: HIJSMM301BX288.46.26.C04.1.454.light.4.raw

SEQ ID NO: 546806 - DNA, 504 bp, Homo sapiens
  misc_feature: HIJSMM301CAPLC.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtggtattcggcggagggaccaaactgaccgtcctaggtcagccaaggctgccccctcggt

SEQ ID NO: 546807 - DNA, 485 bp, Homo sapiens; identical to SEQ ID NO: 535606
  misc_feature: HIJSMM301BJYFG.47.46.E02.1.454.light.4.raw

SEQ ID NO: 546808 - DNA, 512 bp, Homo sapiens; identical to SEQ ID NO: 542831
  misc_feature: HIJSMM301AP902.43.19.B08.1.454.light.4.raw

SEQ ID NO: 546809 - DNA, 488 bp, Homo sapiens
  misc_feature: HIJSMM301AU52I.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtaccccctcacttcgtcggaggacgacgaggagatcagagaactagtggcgtgcaccactctcgtcttctt

SEQ ID NO: 546810 - DNA, 493 bp, Homo sapiens; identical to SEQ ID NO: 543205
  misc_feature: HIJSMM301DDZDT.51.6.A06.1.454.light.4.raw

SEQ ID NO: 546811 - DNA, 497 bp, Homo sapiens; identical to SEQ ID NO: 536376
  misc_feature: HIJSMM301AHYDV.22.9.A09.1.454.light.4.raw

SEQ ID NO: 546812 - DNA, 491 bp, Homo sapiens; identical to SEQ ID NO: 535726
  misc_feature: HIJSMM301AZGE7.14.55.E11.1.454.light.4.raw

SEQ ID NO: 546813 - DNA, 441 bp, Homo sapiens
  misc_feature: HIJSMM301ETFPV.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctcgttcccaccctcctcgtatctctg

SEQ ID NO: 546814 - DNA, 481 bp, Homo sapiens; identical to SEQ ID NO: 542530
  misc_feature: HIJSMM301ELPZS.4.74.G08.1.454.light.4.raw

SEQ ID NO: 546815 - DNA, 487 bp, Homo sapiens; identical to SEQ ID NO: 538190
  misc_feature: HIJSMM301AICCB.47.70.G04.1.454.light.4.raw

SEQ ID NO: 546816 - DNA, 493 bp, Homo sapiens; identical to SEQ ID NO: 536246
  misc_feature: HIJSMM301A0DVS.49.66.F11.1.454.light.4.raw

SEQ ID NO: 546817 - DNA, 486 bp, Homo sapiens; identical to SEQ ID NO: 535043
  misc_feature: HIJSMM301CDMQL.46.35.D02.1.454.light.4.raw

SEQ ID NO: 546818 - DNA, 486 bp, Homo sapiens
  misc_feature: HIJSMM301DYL5T.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggaggaccgaaggtggagatcaaacgaa

SEQ ID NO: 546819 - DNA, 483 bp, Homo sapiens
  misc_feature: HIJSMM301AIQGR.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggagtctggcacagacttcattctcaccatcagcagcctgcagcctgaagattttgcaacttattactgtctacaagatcacaattatcctggacgttcggccaagggaccaaggtggaatacaacgaaactgtggctgcaccatctgtcttcta

SEQ ID NO: 546820 - DNA, 479 bp, Homo sapiens; identical to SEQ ID NO: 535118
  misc_feature: HIJSMM301CLEDN.13.59.F04.1.454.light.4.raw

SEQ ID NO: 546821 - DNA, 496 bp, Homo sapiens
  misc_feature: HIJSMM301DSQHU.51.42.D09.1.454.light.4.raw
cgatcgtatacacgaccggtgctcgatttagacacatacgcagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccagggacacgactggaggttaacgaactgtggctgcat

SEQ ID NO: 546822 - DNA, 501 bp, Homo sapiens
  misc_feature: HIJSMM301CHNUM.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagccaaggctgccccctc

SEQ ID NO: 546823 - DNA, 441 bp, Homo sapiens; identical to SEQ ID NO: 534971
  misc_feature: HIJSMM301C6OCN.11.3.A03.1.454.light.4.raw

SEQ ID NO: 546824 - DNA, 506 bp, Homo sapiens
  misc_feature: HIJSMM301DII77.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccacttcggccctgggaccaaggtggagatcaacgaactgtggctgcaccatctgtcttcta

SEQ ID NO: 546825 - DNA, 494 bp, Homo sapiens; identical to SEQ ID NO: 540767
  misc_feature: HIJSMM301DVMD3.11.81.H04.1.454.light.4.raw

SEQ ID NO: 546826 - DNA, 496 bp, Homo sapiens; identical to SEQ ID NO: 535109
  misc_feature: HIJSMM301AFPXE.16.78.H01.1.454.light.4.raw

SEQ ID NO: 546827 - DNA, 485 bp, Homo sapiens
  misc_feature: HIJSMM301CPHL1.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggctcaggacttatgtcttcggaactgggacccacgttaccgtcctaggtcagcccc

SEQ ID NO: 546828 - DNA, 504 bp, Homo sapiens
  misc_feature: HIJSMM301EK7MB.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactagtggctgcaccatctgt

SEQ ID NO: 546829 - DNA, 501 bp, Homo sapiens; identical to SEQ ID NO: 536142
  misc_feature: HIJSMM301BWRMA.15.1.A01.1.454.light.4.raw

SEQ ID NO: 546830 - DNA, 489 bp, Homo sapiens; identical to SEQ ID NO: 544582
  misc_feature: HIJSMM301CR3SQ.22.65.F10.1.454.light.4.raw

SEQ ID NO: 546831 - DNA, 504 bp, Homo sapiens; identical to SEQ ID NO: 538423
  misc_feature: HIJSMM301AMUU7.48.67.G01.1.454.light.4.raw

SEQ ID NO: 546832 - DNA, 502 bp, Homo sapiens
  misc_feature: HIJSMM301CS3AL.2.76.G10.1.454.light.4.raw
  modified_base (463)..(463): a, c, t, g, unknown or other
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtncttatctcttcggactgggaccaaggtcaccgttctggt

SEQ ID NO: 546833 - DNA, 486 bp, Homo sapiens; identical to SEQ ID NO: 535043
  misc_feature: HIJSMM301AUEXG.46.35.D02.1.454.light.4.raw

SEQ ID NO: 546834 - DNA, 495 bp, Homo sapiens; identical to SEQ ID NO: 535821
  misc_feature: HIJSMM301CVUX9.3.31.C09.1.454.light.4.raw

SEQ ID NO: 546835 - DNA, 514 bp, Homo sapiens
  misc_feature: HIJSMM301DH57G.5.58.F03.1.454.light.4.raw
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccccactcgtcactcttcg

SEQ ID NO: 546836 - DNA, 471 bp, Homo sapiens
  misc_feature: HIJSMM301B0V20.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggaccaaggtggacatcaaacgaa

SEQ ID NO: 546837 - DNA, 447 bp, Homo sapiens
  misc_feature: HIJSMM301CTWOO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccactgtcactctgttcccgccctcctccatactcgta

SEQ ID NO: 546838 - DNA, 500 bp, Homo sapiens
  misc_feature: HIJSMM301CT9RV.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtgacgttcggccaagggaccaaggagcaaatacaacgaactagtggctgcaccatctgtcttctatcttcccgtcccat

SEQ ID NO: 546839 - DNA, 497 bp, Homo sapiens
  misc_feature: HIJSMM301CT8U5.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctcgt

SEQ ID NO: 546840 - DNA, 499 bp, Homo sapiens; identical to SEQ ID NO: 537739
  misc_feature: HIJSMM301BTOPG.12.86.H09.1.454.light.4.raw

SEQ ID NO: 546841 - DNA, 492 bp, Homo sapiens
  misc_feature: HIJSMM301B0YWN.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccaggggaccgaagctggaggatcacaggaacgtgtggctgcaccat

SEQ ID NO: 546842 - DNA, 487 bp, Homo sapiens; identical to SEQ ID NO: 546110
  misc_feature: HIJSMM301EQFOC.41.22.B11.1.454.light.4.raw

SEQ ID NO: 546843 - DNA, 445 bp, Homo sapiens
  misc_feature: HIJSMM301EGDWR.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttccccgccctcctcagacgtatca

SEQ ID NO: 546844 - DNA, 504 bp, Homo sapiens; identical to SEQ ID NO: 537776
  misc_feature: HIJSMM301B6SZL.8.71.G05.1.454.light.4.raw

SEQ ID NO: 546845 - DNA, 504 bp, Homo sapiens
  misc_feature: HIJSMM301B1YQR.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcagggggcattcggcggagggaccaagctgaccgtcctgggtcagcccaaggctgccccctcggtcactc

SEQ ID NO: 546846 - DNA, 505 bp, Homo sapiens; identical to SEQ ID NO: 539292
  misc_feature: HIJSMM301DXRPP.19.85.H08.1.454.light.4.raw

SEQ ID NO: 546847 - DNA, 505 bp, Homo sapiens; identical to SEQ ID NO: 535503
  misc_feature: HIJSMM301B8TMP.8.28.C06.1.454.light.4.raw

SEQ ID NO: 546848 - DNA, 494 bp, Homo sapiens; identical to SEQ ID NO: 534992
  misc_feature: HIJSMM301BWISG.9.1.A01.1.454.light.4.raw

SEQ ID NO: 546849 - DNA, 383 bp, Homo sapiens; identical to SEQ ID NO: 447524
  misc_feature: HIJSMM301CWBB0.41.26.C04.1.454.light.4.raw

SEQ ID NO: 546850 - DNA, 507 bp, Homo sapiens
  misc_feature: HIJSMM301EGTB2.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagcccaaggctgccccctcggtcactctgttcccc

SEQ ID NO: 546851 - DNA, 491 bp, Homo sapiens; identical to SEQ ID NO: 535294
  misc_feature: HIJSMM301C4VAJ.16.68.G02.1.454.light.4.raw

SEQ ID NO: 546852 - DNA, 495 bp, Homo sapiens; identical to SEQ ID NO: 535486
  misc_feature: HIJSMM301AE7NF.26.72.G06.1.454.light.4.raw

SEQ ID NO: 546853 - DNA, 460 bp, Homo sapiens; identical to SEQ ID NO: 537107
  misc_feature: HIJSMM301D17LN.22.28.C06.1.454.light.4.raw

SEQ ID NO: 546854 - DNA, 488 bp, Homo sapiens; identical to SEQ ID NO: 544752
  misc_feature: HIJSMM301EMKV5.14.55.E11.1.454.light.4.raw

SEQ ID NO: 546855 - DNA, 417 bp, Homo sapiens
  misc_feature: HIJSMM301AY7HJ.10.86.H09.1.454.light.4.raw
catagtagtgcacgaccggtgctcgatttagtgctatagacttggggggtgagggttgagaacctatgaacattctgtaggggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcacctggctccagaccggggacgaggccgattattactgcgcaacttgggactccaacctgactgttggggctttcggcggagggactaagttgaccgtcctacgtcagcccaaggctgccccctcggtcactctgttcccaccctcctccacactatg

SEQ ID NO: 546856 - DNA, 479 bp, Homo sapiens
  misc_feature: HIJSMM301DL9JU.7.76.G10.1.454.light.4.raw
cgtgtctctacacgaccggtgctcgatttagtcactcatacagggggcgaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgcctatcagtcagcctgcagcctgaagatttgcaacttctattgtcaacaggctaacagtttccgctcaccttcggcgggggaccaaggtggagatcaaacgaactgtggctgcacc

SEQ ID NO: 546857 - DNA, 513 bp, Homo sapiens
  misc_feature: HIJSMM301DTN8H.8.88.H11.1.454.light.4.raw
ctcgcgtgtccacgaccggtgctcgatttagcgacagcgagaacacacaaagggggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcctgcca

SEQ ID NO: 546858 - DNA, 509 bp, Homo sapiens
  misc_feature: HIJSMM301BEY2S.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaactagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggagatcaaacgaactgtggctgcaccatctgtcttcta

SEQ ID NO: 546859 - DNA, 482 bp, Homo sapiens
  misc_feature: HIJSMM301CCPG9.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcgtcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtt

SEQ ID NO: 546860 - DNA, 475 bp, Homo sapiens
  misc_feature: HIJSMM301C79SS.2.82.H05.1.454.light.4.raw
acgctcgacacacgaccggtgctcgatttagtcgagctctctcgcgggggtgggtccaggaggcagaactctgggtgtctcaccatggcctggatccctctacttctccccctcttcactctctgcacaggctctgaggcctcctatgagctgacacagccaccgtcggtgtcagtgtccccaggacagacggccaggatcacctgctctggagatgcattgccagatcaatatgctaattggtaccagcagaagccaggccaggcccctgtgctggtgatatataaagacagtgagaggccctcagggatccctgagcgattctctggctccagctcagggacaacagtcacgttgaccatcagtggagtccaggcagaggatgaggctgactattactgtcaatcagcagacaccagtggtaatgattatgtcttcggaactgggaccaaggtcaccgtcctaggtcagcccc

SEQ ID NO: 546861 - DNA, 514 bp, Homo sapiens; identical to SEQ ID NO: 546238
  misc_feature: HIJSMM301A43N2.47.85.H08.1.454.light.4.raw

SEQ ID NO: 546862 - DNA, 546 bp, Homo sapiens
  misc_feature: HIJSMM301EJYOQ.14.26.C04.1.454.light.4.raw
cgtctagtaccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctgagta

SEQ ID NO: 546863 - DNA, 511 bp, Homo sapiens
  misc_feature: HIJSMM301CBLKD.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactcgtcactctgttcccgt

SEQ ID NO: 546864 - DNA, 472 bp, Homo sapiens
  misc_feature: HIJSMM301DKEVO.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgccgctatgtcttcggaactgggaccaaggtcacgtcctaagtcacg

SEQ ID NO: 546865 - DNA, 473 bp, Homo sapiens; identical to SEQ ID NO: 538875
  misc_feature: HIJSMM301BXC0F.4.75.G09.1.454.light.4.raw

SEQ ID NO: 546866 - DNA, 501 bp, Homo sapiens; identical to SEQ ID NO: 543209
  misc_feature: HIJSMM301CKBVX.52.55.E11.1.454.light.4.raw

SEQ ID NO: 546867 - DNA, 484 bp, Homo sapiens; identical to SEQ ID NO: 540581
  misc_feature: HIJSMM301B0JV8.3.88.H11.1.454.light.4.raw

SEQ ID NO: 546868 - DNA, 497 bp, Homo sapiens
  misc_feature: HIJSMM301ATH5Y.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtgggataatcagagaactagtggct

SEQ ID NO: 546869 - DNA, 488 bp, Homo sapiens; identical to SEQ ID NO: 537260
  misc_feature: HIJSMM301B3VGF.47.70.G04.1.454.light.4.raw

SEQ ID NO: 546870 - DNA, 485 bp, Homo sapiens
  misc_feature: HIJSMM301ENMTX.7.75.G09.1.454.light.4.raw
  modified_base (457)..(457): a, c, t, g, unknown or other
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctcgtgggagacacagtcaccatcaattgtcgggcgagtcaggatgttggcgaccgcttagtctggtatcagcagaaaccaggaaaaggccctagaactcctaatctatggtgcgtcccggttgcacagtggcggtcccaggaagattcagcggcggtggatctagggcagatttcactctcaccatcaatcacctgcaggctgaggattttgcaacttactactgtcagcaggctaacaggctgccccaacttcggccagggacacgactggagnttaaacgaactgtggctgcaccatctgt

SEQ ID NO: 546871 - DNA, 492 bp, Homo sapiens; identical to SEQ ID NO: 540428
  misc_feature: HIJSMM301B1OMQ.51.81.H04.1.454.light.4.raw

SEQ ID NO: 546872 - DNA, 504 bp, Homo sapiens
  misc_feature: HIJSMM301AYQDW.9.53.E09.1.454.light.4.raw
tgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccccg

SEQ ID NO: 546873 - DNA, 490 bp, Homo sapiens
  misc_feature: HIJSMM301C71OU.5.55.E11.1.454.light.4.raw
atcagacacgcacgaccggtgctcgatttagcactcgcacgttgggtttgggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacaatttcaacagtaagaactacttagcttggtaccagcagaaaccaggacagcctcctaggctgctcatttactgggcatctacccgggaatccggggtccctgaccgattcagtggcagcggctctgggacagatttcactctcaccatcagcagcctgcaggctgaagatgtggcagtttattactgtcagcaatattttattactcctctgacgttcggccaagggaccaaggtggaaatcaaacgaactgtgg

SEQ ID NO: 546874 - DNA, 507 bp, Homo sapiens; identical to SEQ ID NO: 535641
  misc_feature: HIJSMM301E2WQX.10.88.H11.1.454.light.4.raw

SEQ ID NO: 546875 - DNA, 508 bp, Homo sapiens
  misc_feature: HIJSMM301CF4UE.48.15.B04.1.454.light.4.raw
  modified_base (373)..(373): a, c, t, g, unknown or other
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttacnctcaccatcactaccctgcaggctgaagatgtggcagtttattactgtcaacaatattattctactccgccgacgttcggccgggggaccgaacgtggaaatcaaacgaactgtggctgcaccatctgtcttcta

SEQ ID NO: 546876 - DNA, 484 bp, Homo sapiens; identical to SEQ ID NO: 535240
  misc_feature: HIJSMM301CLFWU.47.60.F05.1.454.light.4.raw

SEQ ID NO: 546877 - DNA, 487 bp, Homo sapiens
  misc_feature: HIJSMM301DQ3OR.41.44.D11.1.454.light.4.raw
tctatactatcacgaccggtgctcgatttagcgcagtacgaaggggactgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaa

SEQ ID NO: 546878 - DNA, 489 bp, Homo sapiens; identical to SEQ ID NO: 535139
  misc_feature: HIJSMM301APA9I.14.55.E11.1.454.light.4.raw

SEQ ID NO: 546879 - DNA, 511 bp, Homo sapiens; identical to SEQ ID NO: 537464
  misc_feature: HIJSMM301DRG58.7.34.D01.1.454.light.4.raw

SEQ ID NO: 546880 - DNA, 504 bp, Homo sapiens; identical to SEQ ID NO: 540538
  misc_feature: HIJSMM301CB1TG.7.71.G05.1.454.light.4.raw

SEQ ID NO: 546881 - DNA, 488 bp, Homo sapiens
  misc_feature: HIJSMM301DMVSZ.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggccacgggaccgacggtcggagtgtctaagacgaactgtggcgtgcaccat

SEQ ID NO: 546882 - DNA, 514 bp, Homo sapiens
  misc_feature: HIJSMM301AZ8SJ.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgccctcctca

SEQ ID NO: 546883 - DNA, 485 bp, Homo sapiens
  misc_feature: HIJSMM301DIBPM.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatccaccttcggccggggacacggctggaaactaacgaactgtggctgcacca

SEQ ID NO: 546884 - DNA, 489 bp, Homo sapiens
  misc_feature: HIJSMM301CET0F.14.55.E11.1.454.light.4.raw
cgtctagtaccacgaccggtgctcgatttagcactcgcacgttgggtttggggagtctcaatcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 546885 - DNA, 416 bp, Homo sapiens; identical to SEQ ID NO: 536892
  misc_feature: HIJSMM301C8EQZ.16.46.E02.1.454.light.4.raw

SEQ ID NO: 546886 - DNA, 503 bp, Homo sapiens
  misc_feature: HIJSMM301DVL4K.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcggccaaggaccgaaggtggaaatcaaacgaactgtggctgcaccat

SEQ ID NO: 546887 - DNA, 501 bp, Homo sapiens
  misc_feature: HIJSMM301EHD1K.40.4.A04.1.454.light.4.raw
  modified_base (390)..(390): a, c, t, g, unknown or other
tctagcgactcacgaccggtgctcgatttagagtagtgatcaggggggccgtttgcattgtgaactgagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttacnctcaccatcaccagccttcaggctgaagatgtggcagtttattactgtcaccaatatttagacattcctccgacgttcggccaagggaccaaggtggagatcaaacgaact

SEQ ID NO: 546888 - DNA, 447 bp, Homo sapiens; identical to SEQ ID NO: 535201
  misc_feature: HIJSMM301D45J7.18.9.A09.1.454.light.4.raw

SEQ ID NO: 546889 - DNA, 501 bp, Homo sapiens; identical to SEQ ID NO: 540528
  misc_feature: HIJSMM301B9Q96.11.31.C09.1.454.light.4.raw

SEQ ID NO: 546890 - DNA, 487 bp, Homo sapiens; identical to SEQ ID NO: 538190
  misc_feature: HIJSMM301AOM99.47.70.G04.1.454.light.4.raw

SEQ ID NO: 546891 - DNA, 494 bp, Homo sapiens; identical to SEQ ID NO: 535629
  misc_feature: HIJSMM301ALI1D.4.27.C05.1.454.light.4.raw

SEQ ID NO: 546892 - DNA, 498 bp, Homo sapiens; identical to SEQ ID NO: 545227
  misc_feature: HIJSMM301BK8N8.5.20.B09.1.454.light.4.raw

SEQ ID NO: 546893 - DNA, 496 bp, Homo sapiens
  misc_feature: HIJSMM301DE72G.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 546894 - DNA, 484 bp, Homo sapiens; identical to SEQ ID NO: 535400
  misc_feature: HIJSMM301EW9N2.46.26.C04.1.454.light.4.raw

SEQ ID NO: 546895 - DNA, 503 bp, Homo sapiens; identical to SEQ ID NO: 535044
  misc_feature: HIJSMM301AXWJQ.19.78.H01.1.454.light.4.raw

SEQ ID NO: 546896 - DNA, 483 bp, Homo sapiens
  misc_feature: HIJSMM301DM6N1.43.7.A07.1.454.light.4.raw
  modified_base (441)..(441): a, c, t, g, unknown or other
tgtgagtagtcacgaccggtgctcgatttagcacgtgtcgcagggggggtctcaggaggcagcactctcgggacgtctccaccatggcctgggctctgctcctcctcagcctcctcactcagggcacaggatcgtggtctcagtctgccctgactcagcctcgctctctatccgggtctcctggacagtcagtcaccatcccctgcactggaaccagcaatgatgttggtacttataatcatgtctcctggtaccaacaatacccaggcaaggcccccaaactcatcatttatcatgtcagtgagcggccctcaggggtccctgatcgcttctctggctccaagtctggcaacacggcctccctgaccatctctgggctccagggtgaggatgaggctgaatattattgctgctcatatgctgtcatgggaggcagtttgngggtgttcggcggagggacccagctgaccgtcctaggtcacg

SEQ ID NO: 546897 - DNA, 503 bp, Homo sapiens
  misc_feature: HIJSMM301AVC57.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctggtcagcccaaggctgccccctcggtct

SEQ ID NO: 546898 - DNA, 496 bp, Homo sapiens; identical to SEQ ID NO: 535109
  misc_feature: HIJSMM301BR4YJ.16.78.H01.1.454.light.4.raw

SEQ ID NO: 546899 - DNA, 484 bp, Homo sapiens
  misc_feature: HIJSMM301C3VQD.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaacgaactgtgctgcaccat

SEQ ID NO: 546900 - DNA, 498 bp, Homo sapiens
  misc_feature: HIJSMM301ESRTE.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggggcccagactatggatgaggctgactattactgtcaggcgtgggacagcaattctgtgattttcggcggagggaccaagttgaccgtcctaggttcagcccaaggctgccccctcggtcactctcg

SEQ ID NO: 546901 - DNA, 489 bp, Homo sapiens; identical to SEQ ID NO: 535139
  misc_feature: HIJSMM301D08OT.14.55.E11.1.454.light.4.raw

SEQ ID NO: 546902 - DNA, 503 bp, Homo sapiens
  misc_feature: HIJSMM301ECNTG.14.57.F02.1.454.light.4.raw
cgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcacgtttcggcgggggaccgaaggtggagttcaaacgaactgtggctgcaccatctgtcttcatcttcccg

SEQ ID NO: 546903 - DNA, 503 bp, Homo sapiens
  misc_feature: HIJSMM301EN28N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttctcgggcgttcggccaagggaccaaggtggaaatacaaacgaactagtggctgcaccatctgtcttcatcttccccg

SEQ ID NO: 546904 - DNA, 487 bp, Homo sapiens
  misc_feature: HIJSMM301B9HI5.3.10.A10.1.454.light.4.raw
agacgcactccacgaccggtgctcgatttagcgtcgatctcagggggctgtgggtccaggaggcagaactctgggtgtctcactatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaacggaccaa

SEQ ID NO: 546905 - DNA, 497 bp, Homo sapiens
  misc_feature: HIJSMM301EPN3O.52.35.D02.1.454.light.4.raw
cgcagtacgacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 546906 - DNA, 500 bp, Homo sapiens; identical to SEQ ID NO: 541811
  misc_feature: HIJSMM301B96VX.21.81.H04.1.454.light.4.raw

SEQ ID NO: 546907 - DNA, 487 bp, Homo sapiens; identical to SEQ ID NO: 539929
  misc_feature: HIJSMM301BQOZQ.21.52.E08.1.454.light.4.raw

SEQ ID NO: 546908 - DNA, 488 bp, Homo sapiens
  misc_feature: HIJSMM301A7H9H.8.74.G08.1.454.light.4.raw
ctcgcgtgtccacgaccggtgctcgatttagtagctctatcaggggggggtcgacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatcacctgcactggatccagcggagacattgggagttatgatgttgtctcttggtatcagcatcacccaggcacagccaccaaattcataatttatcaggtcacgcagcggcccttaggggtttcttgatcgcttctctggctccaagtctggcaacacggcctccctgacaatctctgggctccagcctgaggacgaggctgattattactgctgctcatatggtggttctaacactccctatgtcttcggaggtgggaccaaggtcaccgtcctgcgtcagcccaac

SEQ ID NO: 546909 - DNA, 492 bp, Homo sapiens; identical to SEQ ID NO: 536010
  misc_feature: HIJSMM301BVAHZ.10.20.B09.1.454.light.4.raw

SEQ ID NO: 546910 - DNA, 494 bp, Homo sapiens; identical to SEQ ID NO: 534992
  misc_feature: HIJSMM301DWO1D.9.1.A01.1.454.light.4.raw

SEQ ID NO: 546911 - DNA, 495 bp, Homo sapiens; identical to SEQ ID NO: 535007
  misc_feature: HIJSMM301BJZJG.22.5.A05.1.454.light.4.raw

SEQ ID NO: 546912 - DNA, 494 bp, Homo sapiens; identical to SEQ ID NO: 534994
  misc_feature: HIJSMM301EKJ5V.27.78.H01.1.454.light.4.raw

SEQ ID NO: 546913 - DNA, 499 bp, Homo sapiens
  misc_feature: HIJSMM301DR3BI.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacactttatgtcttcggaattgggacgacggtcaccgtctaggtcagcccaaggccaaccccactgtcactctgttcccaccctcctcactactcaca

SEQ ID NO: 546914 - DNA, 508 bp, Homo sapiens
  misc_feature: HIJSMM301BLHSV.17.41.D08.1.454.light.4.raw
cgtagactagcacgaccggtgctcgatttagtcacgcgagaaagggaaagggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 546915 - DNA, 520 bp, Homo sapiens
  misc_feature: HIJSMM301AMIOF.48.33.C11.1.454.light.4.raw
agtatacatacacgaccggtgctcgatttagagtgagctcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcgggagggaccgaagctgaccgtcctgggtcacgccaacggctcgccccctccggtcacctctcgttcccaccctt

SEQ ID NO: 546916 - DNA, 494 bp, Homo sapiens; identical to SEQ ID NO: 535276
  misc_feature: HIJSMM301C86HO.16.6.A06.1.454.light.4.raw

SEQ ID NO: 546917 - DNA, 505 bp, Homo sapiens; identical to SEQ ID NO: 535503
  misc_feature: HIJSMM301CBRXE.8.28.C06.1.454.light.4.raw

SEQ ID NO: 546918 - DNA, 485 bp, Homo sapiens
  misc_feature: HIJSMM301DJHZV.51.3.A03.1.454.light.4.raw
cgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggagggaccaaactgaccgtcctaggtcagcccaaggctgccccctc

SEQ ID NO: 546919 - DNA, 469 bp, Homo sapiens
  misc_feature: HIJSMM301EG33B.18.76.G10.1.454.light.4.raw
  modified_base (460)..(460): a, c, t, g, unknown or other
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagtattttaatttcaccatcagcagcctccaacgtgatgatgttgcaacatactattgtcagcaatatgattttgctcctccgagtgccacttttggcgggggacgagtgganatcaacgaa

SEQ ID NO: 546920 - DNA, 489 bp, Homo sapiens; identical to SEQ ID NO: 544280
  misc_feature: HIJSMM301B9K7D.4.27.C05.1.454.light.4.raw

SEQ ID NO: 546921 - DNA, 493 bp, Homo sapiens; identical to SEQ ID NO: 540693
  misc_feature: HIJSMM301DC1O6.22.65.F10.1.454.light.4.raw

SEQ ID NO: 546922 - DNA, 460 bp, Homo sapiens
  misc_feature: HIJSMM301ETJOZ.41.14.B03.1.454.light.4.raw
tctatactatcacgaccggtgctcgatttagtgtgagtagttccgcgggcacgaccggtgctcgatttagtgtgagtagttccgcgggcacgaccggtgctcgatttagacgcgatcgaagggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 546923 - DNA, 494 bp, Homo sapiens; identical to SEQ ID NO: 535629
  misc_feature: HIJSMM301AHB6Q.4.27.C05.1.454.light.4.raw

SEQ ID NO: 546924 - DNA, 520 bp, Homo sapiens
  misc_feature: HIJSMM301DRHSK.9.38.D05.1.454.light.4.raw
tgatacgtctcacgaccggtgctcgatttagtatctgatagttgggtttgggggggtcgtcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaatacccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcgcgggggaccaaggtgaccgtcctaagtcagccaaggctgccccctcggtcactctgttcccaccctcctcacg

SEQ ID NO: 546925 - DNA, 495 bp, Homo sapiens
  misc_feature: HIJSMM301DOXO2.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtaccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtct

SEQ ID NO: 546926 - DNA, 492 bp, Homo sapiens; identical to SEQ ID NO: 539630
  misc_feature: HIJSMM301AW244.22.25.C03.1.454.light.4.raw

SEQ ID NO: 546927 - DNA, 479 bp, Homo sapiens
  misc_feature: HIJSMM301AGMRQ.48.67.G01.1.454.light.4.raw
agtatacatacacgaccggtgctcgatttagagtatacatattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 546928 - DNA, 494 bp, Homo sapiens
  misc_feature: HIJSMM301EG6B9.27.78.H01.1.454.light.4.raw
  modified_base (429)..(429): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaactttattactgtcatcagagtactactttaccncaagtgatcaccttcggccaagggacacgactggagattaaacgaactgtggctgcaccatctgt

SEQ ID NO: 546929 - DNA, 440 bp, Homo sapiens
  misc_feature: HIJSMM301CWR10.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggaggaccaagctgaccgtctaagtcagccaaggctgcccctcggtcactctgttcccaccctcctccgtgtctgat

SEQ ID NO: 546930 - DNA, 484 bp, Homo sapiens; identical to SEQ ID NO: 535400
  misc_feature: HIJSMM301A12YD.46.26.C04.1.454.light.4.raw

SEQ ID NO: 546931 - DNA, 494 bp, Homo sapiens; identical to SEQ ID NO: 534994
  misc_feature: HIJSMM301CJZ78.27.78.H01.1.454.light.4.raw

SEQ ID NO: 546932 - DNA, 481 bp, Homo sapiens
  misc_feature: HIJSMM301DVGB2.4.34.D01.1.454.light.4.raw
agcactgtagcacgaccggtgctcgatttagatcgtctgtgttgggtttggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtggctgca

SEQ ID NO: 546933 - DNA, 494 bp, Homo sapiens
  misc_feature: HIJSMM301A2QMF.27.78.H01.1.454.light.4.raw
  modified_base (388)..(388): a, c, t, g, unknown or other
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagntgctgcaacttattactgtcatcagagtactactttacctcaagtgatcaccttcggccaagggacacgactggagattaaacgaactgtggctgcaccatctgtt

SEQ ID NO: 546934 - DNA, 495 bp, Homo sapiens
  misc_feature: HIJSMM301A9ZX7.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaaagctggagatcaaacgaactgtggctgcaccatctgtctt

SEQ ID NO: 546935 - DNA, 457 bp, Homo sapiens
  misc_feature: HIJSMM301D2VKJ.53.83.H06.1.454.light.4.raw
cgcgtatacacacgaccggtgctcgatttagatcacgtgcgtcgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagcgaccatcacctgttctggagacaaattgactgataaatatgctggctggtatcggcagaagccaggccagtcgcctgtgttggtcatctatcaggatagcaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 546936 - DNA, 508 bp, Homo sapiens
  misc_feature: HIJSMM301EH7GA.4.21.B10.1.454.light.4.raw
agcactgtagcacgaccggtgctcgatttagtgtcgtcgcaagagagagaggaggggggggctcaggaggcagagctctgggaatctcaccatggcctggacccctctcctgctccccctcctcactttctgcacagtctctgacggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctcg

SEQ ID NO: 546937 - DNA, 493 bp, Homo sapiens
  misc_feature: HIJSMM301C960Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 546938 - DNA, 503 bp, Homo sapiens
  misc_feature: HIJSMM301DTX44.12.37.D04.1.454.light.4.raw
atacgacgtacacgaccggtgctcgatttagtagcatactgttgggtttgggagtcagtctcagtcaggacgcagcatggacatgagggtccccgctcagctcctggggctcctgctactctggctccgaggtgtcagatgtgacgtccagttgattcagtctccagccttcgtgtctgtggatgttggagaggccgtcaccatcacttgccgagcaaatgagagtgtcgacagctttgttaattggtatcaccagaggcaggggaagggcccaaagttaatattatatcggacatatggtttgggagaaggggtcccctcaagatttcatggcgacttttctgggacaaatttcaccctctccatcagcggtctggaacccgatgactttggaaagtattactgccatcagactcacattttccctccgacgttcggccaagggaccatagtggctctcaggcgaactgtggctgcaccatctgtcttcatcttcccgccat

SEQ ID NO: 546939 - DNA, 494 bp, Homo sapiens; identical to SEQ ID NO: 534992
  misc_feature: HIJSMM301A8IGZ.9.1.A01.1.454.light.4.raw

SEQ ID NO: 546940 - DNA, 489 bp, Homo sapiens; identical to SEQ ID NO: 535386
  misc_feature: HIJSMM301BKKZ4.12.51.E07.1.454.light.4.raw

SEQ ID NO: 546941 - DNA, 502 bp, Homo sapiens
  misc_feature: HIJSMM301C230P.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccggggccactttcggccctggaccaagtggatatcaaacgaactgtgctgcaccatctgtctt

SEQ ID NO: 546942 - DNA, 503 bp, Homo sapiens
  misc_feature: HIJSMM301AY8ZZ.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactgtggctgcaccatctgtcttcatt

SEQ ID NO: 546943 - DNA, 487 bp, Homo sapiens; identical to SEQ ID NO: 536536
  misc_feature: HIJSMM301B5AQU.26.45.E01.1.454.light.4.raw

SEQ ID NO: 546944 - DNA, 463 bp, Homo sapiens; identical to SEQ ID NO: 535008
  misc_feature: HIJSMM301AY7BD.10.9.A09.1.454.light.4.raw

SEQ ID NO: 546945 - DNA, 494 bp, Homo sapiens
  misc_feature: HIJSMM301CKMHN.51.81.H04.1.454.light.4.raw
cgatcgtatacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtactttatgtcttcggaactgcgaccaaggtcaccgtcctgggtcagcccaaggccaaccccactgtca

SEQ ID NO: 546946 - DNA, 477 bp, Homo sapiens; identical to SEQ ID NO: 535266
  misc_feature: HIJSMM301DWKJ4.4.34.D01.1.454.light.4.raw

SEQ ID NO: 546947 - DNA, 515 bp, Homo sapiens
  misc_feature: HIJSMM301AUISN.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctggtgggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcgacc

SEQ ID NO: 546948 - DNA, 515 bp, Homo sapiens
  misc_feature: HIJSMM301AU1J2.14.66.F11.1.454.light.4.raw
cgtctagtaccacgaccggtgctcgatttagtcacgcgagagggagcaccgtggagaagacagtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctatggtaaaacatccggccctcagggatcccagaccgattctctggctccaactcaggaaacacagcttccttgaccatcactggggctcaggcggaagatgaggctgactattactgtaattccgggacagcagtgctaaccccaattatgtcttcggaactgggaccaaggtcaccgtcctaggtcagcccaaggccaacccac

SEQ ID NO: 546949 - DNA, 499 bp, Homo sapiens
  misc_feature: HIJSMM301DLGSO.49.68.G02.1.454.light.4.raw
agtcgagagacacgaccggtgctcgatttagtcgatagtgaagggaaagggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtca

SEQ ID NO: 546950 - DNA, 490 bp, Homo sapiens
  misc_feature: HIJSMM301AWC2R.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccc

SEQ ID NO: 546951 - DNA, 484 bp, Homo sapiens; identical to SEQ ID NO: 535400
  misc_feature: HIJSMM301A7MWI.46.26.C04.1.454.light.4.raw

SEQ ID NO: 546952 - DNA, 484 bp, Homo sapiens
  misc_feature: HIJSMM301ASX1E.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgagggaccaagctgaccgtcctgcgtcagcccaaggctgccccctcggtcactctgttcccaccctcctcgctacgtaga

SEQ ID NO: 546953 - DNA, 491 bp, Homo sapiens; identical to SEQ ID NO: 545038
  misc_feature: HIJSMM301ED0DK.22.25.C03.1.454.light.4.raw

SEQ ID NO: 546954 - DNA, 495 bp, Homo sapiens
  misc_feature: HIJSMM301B3KNG.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcggtgttcggcgggggaccaagctgaccgtcctaggtcagcccaaggctgccccctcggtcactctgtt

SEQ ID NO: 546955 - DNA, 471 bp, Homo sapiens; identical to SEQ ID NO: 536384
  misc_feature: HIJSMM301DJX19.18.76.G10.1.454.light.4.raw

SEQ ID NO: 546956 - DNA, 350 bp, Homo sapiens; identical to SEQ ID NO: 537421
  misc_feature: HIJSMM301A94U2.13.11.A11.1.454.light.4.raw

SEQ ID NO: 546957 - DNA, 486 bp, Homo sapiens; identical to SEQ ID NO: 535523
  misc_feature: HIJSMM301CFNWB.22.73.G07.1.454.light.4.raw

SEQ ID NO: 546958 - DNA, 466 bp, Homo sapiens
  misc_feature: HIJSMM301BGF05.11.70.G04.1.454.light.4.raw
cgagagataccacgaccggtgctcgatttagtgtagtgtgaagggaaaggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaaagaatagcgctgccccgctcagtttcggcggagggaccaaggtggagatacg

SEQ ID NO: 546959 - DNA, 484 bp, Homo sapiens
  misc_feature: HIJSMM301C6EQ0.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccgaaagctgaccgtcctaaggtcagaccccg

SEQ ID NO: 546960 - DNA, 514 bp, Homo sapiens
  misc_feature: HIJSMM301EEVQA.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagttgatgttgggggttataaccttgtctcctggtaccaacagcaaccaggcaaagcccccaaacttttggtttatcggggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactgtcactctgtt

SEQ ID NO: 546961 - DNA, 485 bp, Homo sapiens; identical to SEQ ID NO: 545933
  misc_feature: HIJSMM301EJIDZ.47.60.F05.1.454.light.4.raw

SEQ ID NO: 546962 - DNA, 495 bp, Homo sapiens
  misc_feature: HIJSMM301AM14B.11.81.H04.1.454.light.4.raw
  modified_base (403)..(403): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttacngtcagcagtatagtaactggcctccgtacacttttggccaggggaccaagctagaaatcaaacgaactgtggctgtaccatctgtcttcatt

SEQ ID NO: 546963 - DNA, 469 bp, Homo sapiens
  misc_feature: HIJSMM301CRI1H.51.34.D01.1.454.light.4.raw
cgatcgtatacacgaccggtgctcgatttagatcgtctgtgttgggtttgggggcagaagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccaaggtggagatc

SEQ ID NO: 546964 - DNA, 460 bp, Homo sapiens; identical to SEQ ID NO: 539553
  misc_feature: HIJSMM301DVJ12.11.86.H09.1.454.light.4.raw

SEQ ID NO: 546965 - DNA, 441 bp, Homo sapiens; identical to SEQ ID NO: 535074
  misc_feature: HIJSMM301ECB9O.11.3.A03.1.454.light.4.raw

SEQ ID NO: 546966 - DNA, 490 bp, Homo sapiens; identical to SEQ ID NO: 535119
  misc_feature: HIJSMM301DK0E4.51.71.G05.1.454.light.4.raw

SEQ ID NO: 546967 - DNA, 476 bp, Homo sapiens
  misc_feature: HIJSMM301AI09W.49.75.G09.1.454.light.4.raw
agtcgagagacacgaccggtgctcgatttagtatagacatcagggggtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggccgggggaccggaacggtggagatccagcgaacctgtggcgtgca

SEQ ID NO: 546968 - DNA, 493 bp, Homo sapiens; identical to SEQ ID NO: 540127
  misc_feature: HIJSMM301ATPSO.10.17.B06.1.454.light.4.raw

SEQ ID NO: 546969 - DNA, 516 bp, Homo sapiens
  misc_feature: HIJSMM301AU14V.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgcctcctcacg

SEQ ID NO: 546970 - DNA, 444 bp, Homo sapiens; identical to SEQ ID NO: 536685
  misc_feature: HIJSMM301D9Q19.10.76.G10.1.454.light.4.raw

SEQ ID NO: 546971 - DNA, 497 bp, Homo sapiens
  misc_feature: HIJSMM301BC82C.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtattatagttggcctccgtggacgttcggccaagggaccaaggtggaaatcaaacgaaactgtggctgcaccatctgtctt

SEQ ID NO: 546972 - DNA, 415 bp, Homo sapiens
  misc_feature: HIJSMM301CQEKC.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctgttcccaccctcctcgagtgtaca

SEQ ID NO: 546973 - DNA, 509 bp, Homo sapiens
  misc_feature: HIJSMM301BH0P5.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcgaccatctgtcttcatcttcccgcc

SEQ ID NO: 546974 - DNA, 487 bp, Homo sapiens
  misc_feature: HIJSMM301CKKPS.49.35.D02.1.454.light.4.raw
agtcgagagacacgaccggtgctcgatttagcacacgatagttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacgaacg

SEQ ID NO: 546975 - DNA, 511 bp, Homo sapiens
  misc_feature: HIJSMM301AM4B3.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgaacgggaccgaaggtaggaaagtacaaacgaactagtggctgcaccactctgtcttctactcttccccg

SEQ ID NO: 546976 - DNA, 485 bp, Homo sapiens
  misc_feature: HIJSMM301ASE1Y.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcaccatct

SEQ ID NO: 546977 - DNA, 514 bp, Homo sapiens
  misc_feature: HIJSMM301AYX4T.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgtcccacctcctc

SEQ ID NO: 546978 - DNA, 486 bp, Homo sapiens; identical to SEQ ID NO: 535290
  misc_feature: HIJSMM301AHCJ8.3.12.B01.1.454.light.4.raw

SEQ ID NO: 546979 - DNA, 463 bp, Homo sapiens; identical to SEQ ID NO: 535062
  misc_feature: HIJSMM301CEJBB.11.73.G07.1.454.light.4.raw

SEQ ID NO: 546980 - DNA, 473 bp, Homo sapiens
  misc_feature: HIJSMM301BYV08.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtggatatcaaacgaactgtggctgcaccatctgtcttcatccttcccgccat

SEQ ID NO: 546981 - DNA, 486 bp, Homo sapiens; identical to SEQ ID NO: 537583
  misc_feature: HIJSMM301B8UXJ.17.25.C03.1.454.light.4.raw

SEQ ID NO: 546982 - DNA, 503 bp, Homo sapiens
  misc_feature: HIJSMM301DITIA.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagtttttctcgggcgttcggccgaaggaccgaaggtaggaaagtacaaacgaaactagtggctgcacca

SEQ ID NO: 546983 - DNA, 503 bp, Homo sapiens
  misc_feature: HIJSMM301E3L57.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggcggagggaccaaactgaccgtcctaggtcagcccaa

SEQ ID NO: 546984 - DNA, 499 bp, Homo sapiens; identical to SEQ ID NO: 538774
  misc_feature: HIJSMM301CVEGS.26.26.C04.1.454.light.4.raw

SEQ ID NO: 546985 - DNA, 485 bp, Homo sapiens
  misc_feature: HIJSMM301DL1UA.17.25.C03.1.454.light.4.raw
cgtagactagcacgaccggtgctcgatttagtagtgtagatttgggtttgggagtcagtctcagtcaggacacagcatggacatgagggccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgt

SEQ ID NO: 546986 - DNA, 501 bp, Homo sapiens
  misc_feature: HIJSMM301C4K3V.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcaaccacggactcggccctccggtcgactctcgtt

SEQ ID NO: 546987 - DNA, 508 bp, Homo sapiens
  misc_feature: HIJSMM301DQBVR.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggtcccggggaccaaagtggaaatcaaacgaactgtggctgcaccatctgtcttcatcttcccgcc

SEQ ID NO: 546988 - DNA, 501 bp, Homo sapiens
  misc_feature: HIJSMM301ASSIM.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacgaccaacaactgtggttttcggtcggagggaccgaaagctgaccgtcctaggtcacgccaacggctcgccccctccggtcc

SEQ ID NO: 546989 - DNA, 444 bp, Homo sapiens; identical to SEQ ID NO: 535411
  misc_feature: HIJSMM301BT2WD.8.73.G07.1.454.light.4.raw

SEQ ID NO: 546990 - DNA, 490 bp, Homo sapiens
  misc_feature: HIJSMM301B1ZGY.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctctgcatagtaatggatacaactatttggattggtacctgcagaagccagggcagtctccacagctcctgatctattgggttctaatcgggcctcggggtccctgacaggttcagtggcagtggatcaggcacagattttacactgaaaatcagcagagtggaggctgaggatgttggggttattactgcatgcaagctctacaaactccttacacttttggcctaggggacccaagcctggagatcaaacgaactgt

SEQ ID NO: 546991 - DNA, 454 bp, Homo sapiens; identical to SEQ ID NO: 534964
  misc_feature: HIJSMM301D6PAD.19.86.H09.1.454.light.4.raw

SEQ ID NO: 546992 - DNA, 499 bp, Homo sapiens; identical to SEQ ID NO: 546274
  misc_feature: HIJSMM301CBDQM.12.86.H09.1.454.light.4.raw

SEQ ID NO: 546993 - DNA, 490 bp, Homo sapiens; identical to SEQ ID NO: 535936
  misc_feature: HIJSMM301C99IP.16.68.G02.1.454.light.4.raw

SEQ ID NO: 546994 - DNA, 502 bp, Homo sapiens; identical to SEQ ID NO: 536253
  misc_feature: HIJSMM301AJ91M.21.22.B11.1.454.light.4.raw

SEQ ID NO: 546995 - DNA, 503 bp, Homo sapiens
  misc_feature: HIJSMM301BTPA6.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccatgtcactctgttcccgccct

SEQ ID NO: 546996 - DNA, 491 bp, Homo sapiens; identical to SEQ ID NO: 535176
  misc_feature: HIJSMM301AWIO6.13.39.D06.1.454.light.4.raw

SEQ ID NO: 546997 - DNA, 498 bp, Homo sapiens
  misc_feature: HIJSMM301D1L3A.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccagggaccaagctggagatcaacgaactgtggctgcaccatctgtcttcatt

SEQ ID NO: 546998 - DNA, 466 bp, Homo sapiens; identical to SEQ ID NO: 535366
  misc_feature: HIJSMM301CZV6S.13.4.A04.1.454.light.4.raw

SEQ ID NO: 546999 - DNA, 495 bp, Homo sapiens; identical to SEQ ID NO: 535712
  misc_feature: HIJSMM301B2N34.27.78.H01.1.454.light.4.raw

SEQ ID NO: 547000 - DNA, 494 bp, Homo sapiens; identical to SEQ ID NO: 534994
  misc_feature: HIJSMM301A056U.27.78.H01.1.454.light.4.raw

SEQ ID NO: 547001 - DNA, 492 bp, Homo sapiens; identical to SEQ ID NO: 534967
  misc_feature: HIJSMM301DXHI7.47.64.F09.1.454.light.4.raw

SEQ ID NO: 547002 - DNA, 490 bp, Homo sapiens; identical to SEQ ID NO: 535936
  misc_feature: HIJSMM301B266Z.16.68.G02.1.454.light.4.raw

SEQ ID NO: 547003 - DNA, 485 bp, Homo sapiens
  misc_feature: HIJSMM301DRW3W.40.83.H06.1.454.light.4.raw
tctagcgactcacgaccggtgctcgatttagatcacgtgcgtcgcggggaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtcctaggtcagcccaa

SEQ ID NO: 547004 - DNA, 446 bp, Homo sapiens
  misc_feature: HIJSMM301C77N3.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttccccaccctcctccactactatg

SEQ ID NO: 547005 - DNA, 486 bp, Homo sapiens; identical to SEQ ID NO: 535385
  misc_feature: HIJSMM301ASQF3.19.71.G05.1.454.light.4.raw

SEQ ID NO: 547006 - DNA, 510 bp, Homo sapiens
  misc_feature: HIJSMM301BXKRM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccgaaggtggaaagtacaaacgaactagtggcgtgcgaccatctgtcttctatcttccccg

SEQ ID NO: 547007 - DNA, 484 bp, Homo sapiens
  misc_feature: HIJSMM301DK17S.4.12.B01.1.454.light.4.raw
agcactgtagcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgtaacttactattgtcagagttctaattctttcccgcgcacgttttggccaggggaccaaggtagagatcaaacgaactgtggctgcaccatct

SEQ ID NO: 547008 - DNA, 454 bp, Homo sapiens
  misc_feature: HIJSMM301AYJ6B.19.86.H09.1.454.light.4.raw
tactctcgtgcacgaccggtgctcgatttagtgctatagacttgggtttgggggccgttcctgggcccagtctgtgctgactcaggcaccctcagcgtctggggcccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 547009 - DNA, 517 bp, Homo sapiens
  misc_feature: HIJSMM301CAXDH.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccgaagctgaccgtcctaggtcagcccaaggctgccccctcggtcactctcgttcccgccctcctcagacgtatcac

SEQ ID NO: 547010 - DNA, 489 bp, Homo sapiens; identical to SEQ ID NO: 536013
  misc_feature: HIJSMM301EKC5V.26.23.C01.1.454.light.4.raw

SEQ ID NO: 547011 - DNA, 486 bp, Homo sapiens; identical to SEQ ID NO: 535523
  misc_feature: HIJSMM301AQRGO.22.73.G07.1.454.light.4.raw

SEQ ID NO: 547012 - DNA, 499 bp, Homo sapiens
  misc_feature: HIJSMM301D3A5Z.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaaactgtggctgcacc

SEQ ID NO: 547013 - DNA, 486 bp, Homo sapiens; identical to SEQ ID NO: 535043
  misc_feature: HIJSMM301CS0LL.46.35.D02.1.454.light.4.raw

SEQ ID NO: 547014 - DNA, 494 bp, Homo sapiens
  misc_feature: HIJSMM301DB7LW.15.59.F04.1.454.light.4.raw
tctacgtagccacgaccggtgctcgatttagtacacacacttagggattgggggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggtcactctgttcccaccctcctcactacgtaga

SEQ ID NO: 547015 - DNA, 491 bp, Homo sapiens; identical to SEQ ID NO: 535194
  misc_feature: HIJSMM301CITDY.26.78.H01.1.454.light.4.raw

SEQ ID NO: 547016 - DNA, 505 bp, Homo sapiens; identical to SEQ ID NO: 535503
  misc_feature: HIJSMM301B9P4Y.8.28.C06.1.454.light.4.raw

SEQ ID NO: 547017 - DNA, 493 bp, Homo sapiens
  misc_feature: HIJSMM301A03J1.43.72.G06.1.454.light.4.raw
tgtgagtagtcacgaccggtgctcgatttagctacgactgcaagggaaaggggagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatacaaacgaactgtggctgcaccatctgtt

SEQ ID NO: 547018 - DNA, 495 bp, Homo sapiens; identical to SEQ ID NO: 535007
  misc_feature: HIJSMM301DSIPC.22.5.A05.1.454.light.4.raw

SEQ ID NO: 547019 - DNA, 491 bp, Homo sapiens
  misc_feature: HIJSMM301EGXHL.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactagtggctgcaccatctgtcttcatcttcccgcc

SEQ ID NO: 547020 - DNA, 454 bp, Homo sapiens; identical to SEQ ID NO: 536347
  misc_feature: HIJSMM301C8OEI.19.86.H09.1.454.light.4.raw

SEQ ID NO: 547021 - DNA, 483 bp, Homo sapiens; identical to SEQ ID NO: 537371
  misc_feature: HIJSMM301ESN3E.13.55.E11.1.454.light.4.raw

SEQ ID NO: 547022 - DNA, 489 bp, Homo sapiens; identical to SEQ ID NO: 535386
  misc_feature: HIJSMM301BSNFR.12.51.E07.1.454.light.4.raw

SEQ ID NO: 547023 - DNA, 447 bp, Homo sapiens; identical to SEQ ID NO: 535201
  misc_feature: HIJSMM301BE52Q.18.9.A09.1.454.light.4.raw

SEQ ID NO: 547024 - DNA, 447 bp, Homo sapiens; identical to SEQ ID NO: 535020
  misc_feature: HIJSMM301BWDN2.18.9.A09.1.454.light.4.raw

SEQ ID NO: 547025 - DNA, 486 bp, Homo sapiens; identical to SEQ ID NO: 537144
  misc_feature: HIJSMM301BTDMT.46.35.D02.1.454.light.4.raw

SEQ ID NO: 547026 - DNA, 414 bp, Homo sapiens
  misc_feature: HIJSMM301ERA50.10.38.D05.1.454.light.4.raw
catagtagtgcacgaccggtgctcgatttagtatctgatagttggggtttgggggctttgcctgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 547027 - DNA, 494 bp, Homo sapiens
  misc_feature: HIJSMM301COYAN.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgacccatcactggggctcaggcggaagatgaggctgactattactgtaactcccgggccagcagtggtaacattgtgatattcggcggagggaccaaggtgaccgtcctacgtcagcccaaggctgccccctcggtcact

SEQ ID NO: 547028 - DNA, 486 bp, Homo sapiens; identical to SEQ ID NO: 535043
  misc_feature: HIJSMM301DHX83.46.35.D02.1.454.light.4.raw

SEQ ID NO: 547029 - DNA, 487 bp, Homo sapiens
  misc_feature: HIJSMM301BQLD7.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctataccttttggccaggggaccaagctggagatcacaggaactgtggctgcacc

SEQ ID NO: 547030 - DNA, 489 bp, Homo sapiens; identical to SEQ ID NO: 540655
  misc_feature: HIJSMM301AH16J.22.87.H10.1.454.light.4.raw

SEQ ID NO: 547031 - DNA, 505 bp, Homo sapiens
  misc_feature: HIJSMM301B3YEG.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcgcccgtcgggaccaaacgtaggaggatcaaaccaaacgtagtggctgcgaccactcctgtcttt

SEQ ID NO: 547032 - DNA, 502 bp, Homo sapiens
  misc_feature: HIJSMM301A7OYV.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttattactgtcagcaatattatatctctcctcctcggacgttcggccaagggaccgagggtggaaatacaaacgaactgtggctgcaccatctgtcttcatcttcccgccact

SEQ ID NO: 547033 - DNA, 500 bp, Homo sapiens
  misc_feature: HIJSMM301BN7IE.43.34.D01.1.454.light.4.raw
tgtgagtagtcacgaccggtgctcgatttagatcgtctgtgttgggtttgggggggcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccac

SEQ ID NO: 547034 - DNA, 489 bp, Homo sapiens
  misc_feature: HIJSMM301AL395.49.81.H04.1.454.light.4.raw
agtcgagagacacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccgaccggtggaggatcaaacgaactagtggctgcaccat

SEQ ID NO: 547035 - DNA, 493 bp, Homo sapiens; identical to SEQ ID NO: 535657
  misc_feature: HIJSMM301B907H.27.78.H01.1.454.light.4.raw

SEQ ID NO: 547036 - DNA, 447 bp, Homo sapiens; identical to SEQ ID NO: 535201
  misc_feature: HIJSMM301C92ZA.18.9.A09.1.454.light.4.raw

SEQ ID NO: 547037 - DNA, 503 bp, Homo sapiens; identical to SEQ ID NO: 535140
  misc_feature: HIJSMM301AVAKV.18.37.D04.1.454.light.4.raw

SEQ ID NO: 547038 - DNA, 471 bp, Homo sapiens
  misc_feature: HIJSMM301DAMFX.48.32.C10.1.454.light.4.raw
agtatacatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtgggagacagagtcaccatcacttgccgggcaagtcagagcattagcagctatttaaattggtatcagcagaaaccagggaaagcccctaagctcctgatctatggtgcatccattttgcaaagtgggatcccatcagggttcagtggcagtgggtctgggacagatttcactctcaccatcagcagtttgcgacctgaagattttgcaacttactactgtcaacagagttacagtgacccgtacaattttggccaggggaccaagctggagatcaaacgaa

SEQ ID NO: 547039 - DNA, 512 bp, Homo sapiens; identical to SEQ ID NO: 542831
  misc_feature: HIJSMM301CGQLK.43.19.B08.1.454.light.4.raw

SEQ ID NO: 547040 - DNA, 472 bp, Homo sapiens
  misc_feature: HIJSMM301BVKZH.5.53.E09.1.454.light.4.raw
atcagacacgcacgaccggtgctcgatttagagagagtgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcctccgaccttcgccacggacgacgactgagataaagtaacta

SEQ ID NO: 547041 - DNA, 495 bp, Homo sapiens
  misc_feature: HIJSMM301ESM7Q.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacccttcggccaagggacacgactggagattaaacgaactgtggctgcaccatctgtctt

SEQ ID NO: 547042 - DNA, 495 bp, Homo sapiens
  misc_feature: HIJSMM301BULA4.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcact

SEQ ID NO: 547043 - DNA, 483 bp, Homo sapiens
  misc_feature: HIJSMM301AR6ES.51.52.E08.1.454.light.4.raw
cgatcgtatacacgaccggtgctcgatttagtcgagctctcagagagaaagggggctgtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaaatatgctcgttgattccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattctgggatattcggccggagggaccgaagctgaccgtcttaggtcagccccg

SEQ ID NO: 547044 - DNA, 499 bp, Homo sapiens
  misc_feature: HIJSMM301AXB3N.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 547045 - DNA, 495 bp, Homo sapiens; identical to SEQ ID NO: 535596
  misc_feature: HIJSMM301DZQPF.10.79.H02.1.454.light.4.raw

SEQ ID NO: 547046 - DNA, 506 bp, Homo sapiens
  misc_feature: HIJSMM301BISBU.27.78.H01.1.454.light.4.raw
agcgtcgtctcacgaccggtgctcgatttagtgtgagtagtttgggtttggggatcttaaaagaggttctttctctgggagggtgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 547047 - DNA, 487 bp, Homo sapiens
  misc_feature: HIJSMM301C6ZMH.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcgagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccca

SEQ ID NO: 547048 - DNA, 454 bp, Homo sapiens; identical to SEQ ID NO: 536943
  misc_feature: HIJSMM301CWOT1.19.86.H09.1.454.light.4.raw

SEQ ID NO: 547049 - DNA, 503 bp, Homo sapiens
  misc_feature: HIJSMM301CELCX.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 547050 - DNA, 491 bp, Homo sapiens
  misc_feature: HIJSMM301EUMYC.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaaggacacgactggagattaaacgaactgtggctgcacatctgt

SEQ ID NO: 547051 - DNA, 483 bp, Homo sapiens
  misc_feature: HIJSMM301B45P1.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaagaa

SEQ ID NO: 547052 - DNA, 500 bp, Homo sapiens; identical to SEQ ID NO: 544079
  misc_feature: HIJSMM301DB1KP.10.43.D10.1.454.light.4.raw

SEQ ID NO: 547053 - DNA, 491 bp, Homo sapiens
  misc_feature: HIJSMM301EDVMY.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctg

SEQ ID NO: 547054 - DNA, 518 bp, Homo sapiens
  misc_feature: HIJSMM301COPOG.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgagaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccaccctcctccgtcg

SEQ ID NO: 547055 - DNA, 378 bp, Homo sapiens
  misc_feature: HIJSMM301ELPDY.49.42.D09.1.454.light.4.raw
agtcgagagacacgaccggtgctcgatttagacacatacgcagggaaagggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgaggtcaccgtcctgggtcagcccaaggccaaccccactgtcactctgttcccaccctcctctctctcgact

SEQ ID NO: 547056 - DNA, 484 bp, Homo sapiens
  misc_feature: HIJSMM301CU0TK.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaactttggccaggggaccaagctggagatcaacgaactgtggctgcaccat

SEQ ID NO: 547057 - DNA, 502 bp, Homo sapiens
  misc_feature: HIJSMM301CEQBF.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtggatatcaaactaactgtggctgcaccatct

SEQ ID NO: 547058 - DNA, 483 bp, Homo sapiens
  misc_feature: HIJSMM301DZSI1.51.34.D01.1.454.light.4.raw
cgatcgtatacacgaccggtgctcgatttagatcgtctgtgttgggtttgggagggggtcaggctggaactgaggagcaggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacagggccgttgcgctcactttcggcggggggaccgaaggtggagatc

SEQ ID NO: 547059 - DNA, 501 bp, Homo sapiens; identical to SEQ ID NO: 539652
  misc_feature: HIJSMM301A4VSJ.9.71.G05.1.454.light.4.raw

SEQ ID NO: 547060 - DNA, 496 bp, Homo sapiens
  misc_feature: HIJSMM301EXJJ7.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggtttcggcggagggaccaagctgaccgtcctaggtcagcccaaggctgccccccg

SEQ ID NO: 547061 - DNA, 483 bp, Homo sapiens; identical to SEQ ID NO: 542674
  misc_feature: HIJSMM301EQT80.21.25.C03.1.454.light.4.raw

SEQ ID NO: 547062 - DNA, 492 bp, Homo sapiens
  misc_feature: HIJSMM301DENR6.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttatattgtcaacaatattttagtgctccgtacacttttggtccaggggaccgaagttaggagatcaaacgaactgt

SEQ ID NO: 547063 - DNA, 447 bp, Homo sapiens; identical to SEQ ID NO: 535201
  misc_feature: HIJSMM301EUD6I.18.9.A09.1.454.light.4.raw

SEQ ID NO: 547064 - DNA, 488 bp, Homo sapiens
  misc_feature: HIJSMM301BF6R3.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcacat

SEQ ID NO: 547065 - DNA, 478 bp, Homo sapiens; identical to SEQ ID NO: 541928
  misc_feature: HIJSMM301A4A8L.7.76.G10.1.454.light.4.raw

SEQ ID NO: 547066 - DNA, 506 bp, Homo sapiens; identical to SEQ ID NO: 545155
  misc_feature: HIJSMM301A2PA0.9.12.B01.1.454.light.4.raw

SEQ ID NO: 547067 - DNA, 494 bp, Homo sapiens; identical to SEQ ID NO: 535680
  misc_feature: HIJSMM301AT0F5.16.78.H01.1.454.light.4.raw

SEQ ID NO: 547068 - DNA, 487 bp, Homo sapiens; identical to SEQ ID NO: 537220
  misc_feature: HIJSMM301A2NNQ.16.53.E09.1.454.light.4.raw

SEQ ID NO: 547069 - DNA, 487 bp, Homo sapiens; identical to SEQ ID NO: 538190
  misc_feature: HIJSMM301A235S.47.70.G04.1.454.light.4.raw

SEQ ID NO: 547070 - DNA, 438 bp, Homo sapiens
  misc_feature: HIJSMM301C0MIN.11.3.A03.1.454.light.4.raw
  modified_base (420)..(420): a, c, t, g, unknown or other
cgagagataccacgaccggtgctcgatttagagagcgtcacagggtcctgggcccagtctgtgctgacgcagccgccctcagtgtctcgggccccagggcagacggtcaccatctcctgcactggaaacagctccaacgtcgggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgcccctggtcactctgttcccnccctcctcgtatctctcg

SEQ ID NO: 547071 - DNA, 493 bp, Homo sapiens; identical to SEQ ID NO: 539202
  misc_feature: HIJSMM301ECGW5.22.57.F02.1.454.light.4.raw

SEQ ID NO: 547072 - DNA, 501 bp, Homo sapiens
  misc_feature: HIJSMM301DDDDP.2.49.E05.1.454.light.4.raw
acgctcgacacacgaccggtgctcgatttagagcgactagcaacacacaaagggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtccctaggt

SEQ ID NO: 547073 - DNA, 487 bp, Homo sapiens; identical to SEQ ID NO: 538190
  misc_feature: HIJSMM301DJASU.47.70.G04.1.454.light.4.raw

SEQ ID NO: 547074 - DNA, 495 bp, Homo sapiens; identical to SEQ ID NO: 537165
  misc_feature: HIJSMM301A3DZ1.51.14.B03.1.454.light.4.raw

SEQ ID NO: 547075 - DNA, 495 bp, Homo sapiens
  misc_feature: HIJSMM301D049E.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgcactttattactgtcagcagcgtagcaactggcctctcactttcggcggagggaccgaggggtggagatcagacgaactgtggctgcaccatctgtt

SEQ ID NO: 547076 - DNA, 492 bp, Homo sapiens; identical to SEQ ID NO: 537246
  misc_feature: HIJSMM301EYYOB.43.28.C06.1.454.light.4.raw

SEQ ID NO: 547077 - DNA, 492 bp, Homo sapiens
  misc_feature: HIJSMM301CX6OD.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggtctaatcgggcctccggggtccctgacaggttcagtggcagtggatcaggcacagattttacactgaaaatcagcagagtggaggctgaggatgttggggtttattactgcatgcaagctctacaactccttacacttttggccgagggaccaagctggagatcaaacgaactgtggt

SEQ ID NO: 547078 - DNA, 489 bp, Homo sapiens; identical to SEQ ID NO: 540381
  misc_feature: HIJSMM301EIPJ8.51.6.A06.1.454.light.4.raw

SEQ ID NO: 547079 - DNA, 507 bp, Homo sapiens
  misc_feature: HIJSMM301BOPII.51.86.H09.1.454.light.4.raw
cgatcgtatacacgaccggtgctcgatttagtgctatagacttgggtttgggtgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttca

SEQ ID NO: 547080 - DNA, 520 bp, Homo sapiens
  misc_feature: HIJSMM301DP786.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaaccctccgggatccctgagagattctctggctccagctcagggactatggccaccttgactatcagtggggcccgaagtaggaggatgaagctgactactactgttactcaatagagaacaagtgataattattgggtggtttcggcggagggaccgaaactagaaccgtcctacggtcagccaacggctgccccctccggtcactctgttccccg

SEQ ID NO: 547081 - DNA, 472 bp, Homo sapiens; identical to SEQ ID NO: 536302
  misc_feature: HIJSMM301CMIC9.18.76.G10.1.454.light.4.raw

SEQ ID NO: 547082 - DNA, 447 bp, Homo sapiens; identical to SEQ ID NO: 535201
  misc_feature: HIJSMM301AWJZ4.18.9.A09.1.454.light.4.raw

SEQ ID NO: 547083 - DNA, 485 bp, Homo sapiens; identical to SEQ ID NO: 535963
  misc_feature: HIJSMM301AXDQS.15.28.C06.1.454.light.4.raw

SEQ ID NO: 547084 - DNA, 493 bp, Homo sapiens; identical to SEQ ID NO: 535745
  misc_feature: HIJSMM301ELW5G.47.78.H01.1.454.light.4.raw

SEQ ID NO: 547085 - DNA, 490 bp, Homo sapiens
  misc_feature: HIJSMM301BW1MH.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccta

SEQ ID NO: 547086 - DNA, 474 bp, Homo sapiens
  misc_feature: HIJSMM301EQ8OS.48.40.D07.1.454.light.4.raw
agtatacatacacgaccggtgctcgatttagtgatagagcgtaacaacagaggggactgatcaggactcctcagttcaccttctcacaatgaggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcgccgaaggaccgaaggt

SEQ ID NO: 547087 - DNA, 464 bp, Homo sapiens; identical to SEQ ID NO: 537214
  misc_feature: HIJSMM301AO5JA.18.59.F04.1.454.light.4.raw

SEQ ID NO: 547088 - DNA, 518 bp, Homo sapiens
  misc_feature: HIJSMM301AROJW.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggaccgaacggtaggaagtactaacgaaactagtggcgtgcgaccactactcgtcttctactcttcccgtcccact

SEQ ID NO: 547089 - DNA, 463 bp, Homo sapiens; identical to SEQ ID NO: 535008
  misc_feature: HIJSMM301AY3H5.10.9.A09.1.454.light.4.raw

SEQ ID NO: 547090 - DNA, 485 bp, Homo sapiens
  misc_feature: HIJSMM301BN6MV.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgaagacgaactgtggctgcaccatctgtctt

SEQ ID NO: 547091 - DNA, 486 bp, Homo sapiens; identical to SEQ ID NO: 536261
  misc_feature: HIJSMM301DSTHS.26.55.E11.1.454.light.4.raw

SEQ ID NO: 547092 - DNA, 496 bp, Homo sapiens
  misc_feature: HIJSMM301CSD5Z.53.11.A11.1.454.light.4.raw
cgcgtatacacacgaccggtgctcgatttagctacgactgcagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 547093 - DNA, 505 bp, Homo sapiens
  misc_feature: HIJSMM301AHA8X.48.21.B10.1.454.light.4.raw
agtatacatacacgaccggtgctcgatttagtgtcgtcgcaaggagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaatcaaacgaactgtggctgcaccatctgtcttcatcttcccgcc

SEQ ID NO: 547094 - DNA, 460 bp, Homo sapiens; identical to SEQ ID NO: 539553
  misc_feature: HIJSMM301CEZFL.11.86.H09.1.454.light.4.raw

SEQ ID NO: 547095 - DNA, 503 bp, Homo sapiens
  misc_feature: HIJSMM301DQCF8.11.67.G01.1.454.light.4.raw
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccacctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctcggtcact

SEQ ID NO: 547096 - DNA, 486 bp, Homo sapiens; identical to SEQ ID NO: 535043
  misc_feature: HIJSMM301ADDDE.46.35.D02.1.454.light.4.raw

SEQ ID NO: 547097 - DNA, 481 bp, Homo sapiens
  misc_feature: HIJSMM301BY8HK.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcaccat

SEQ ID NO: 547098 - DNA, 509 bp, Homo sapiens; identical to SEQ ID NO: 539269
  misc_feature: HIJSMM301C1OQT.4.57.F02.1.454.light.4.raw

SEQ ID NO: 547099 - DNA, 488 bp, Homo sapiens
  misc_feature: HIJSMM301A1X82.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaactattactgccaacaatatgatattattctccagcgttcggccaggggaccaaggtggaaggtcaagcgaactgtggctgcaccatctgtt

SEQ ID NO: 547100 - DNA, 510 bp, Homo sapiens
  misc_feature: HIJSMM301BJUBT.48.23.C01.1.454.light.4.raw
agtatacatacacgaccggtgctcgatttagtacacgtgattagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccccg

SEQ ID NO: 547101 - DNA, 448 bp, Homo sapiens
  misc_feature: HIJSMM301E1OZR.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcagggtcccgtgactgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccccactgtcactctgttcccgcccctcctccatactcgta

SEQ ID NO: 547102 - DNA, 502 bp, Homo sapiens; identical to SEQ ID NO: 541501
  misc_feature: HIJSMM301EMUMN.17.27.C05.1.454.light.4.raw

SEQ ID NO: 547103 - DNA, 492 bp, Homo sapiens
  misc_feature: HIJSMM301B7TRS.47.48.E04.1.454.light.4.raw
agctcacgtacacgaccggtgctcgatttagagagcgtcacagagagaaggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacgggaccgaacggtaggaaagtacaaacgaaactagtggcgtgcacca

SEQ ID NO: 547104 - DNA, 494 bp, Homo sapiens; identical to SEQ ID NO: 534994
  misc_feature: HIJSMM301A37G2.27.78.H01.1.454.light.4.raw

SEQ ID NO: 547105 - DNA, 484 bp, Homo sapiens
  misc_feature: HIJSMM301A8B3Y.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaaggaccaaggtagaatcaacgaactgtgctgcaccatctgtt

SEQ ID NO: 547106 - DNA, 499 bp, Homo sapiens
  misc_feature: HIJSMM301EM3GP.48.29.C07.1.454.light.4.raw
agtatacatacacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggccaaggaccgaaggtaggaaatacaaacgaactagtggctgcacca

SEQ ID NO: 547107 - DNA, 471 bp, Homo sapiens; identical to SEQ ID NO: 536384
  misc_feature: HIJSMM301D0S94.18.76.G10.1.454.light.4.raw

SEQ ID NO: 547108 - DNA, 503 bp, Homo sapiens
  misc_feature: HIJSMM301C0VEM.18.23.C01.1.454.light.4.raw
tacgagtatgcacgaccggtgctcgatttagtacacgtgattagggattgggggagtcagacccagtcaggacacagcatggacacgagggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcttaactactattgtcagcaggcgcacaatttcccgctcactttcggcggagggaccaaggtggagatcaaacgaactgtggctgcaccatctgtcttcatcttccccg

SEQ ID NO: 547109 - DNA, 485 bp, Homo sapiens; identical to SEQ ID NO: 542735
  misc_feature: HIJSMM301DLGXY.26.45.E01.1.454.light.4.raw

SEQ ID NO: 547110 - DNA, 503 bp, Homo sapiens; identical to SEQ ID NO: 537189
  misc_feature: HIJSMM301A6NXU.19.85.H08.1.454.light.4.raw

SEQ ID NO: 547111 - DNA, 464 bp, Homo sapiens; identical to SEQ ID NO: 536640
  misc_feature: HIJSMM301CMDJR.26.78.H01.1.454.light.4.raw

SEQ ID NO: 547112 - DNA, 492 bp, Homo sapiens; identical to SEQ ID NO: 535126
  misc_feature: HIJSMM301ED6ZD.18.11.A11.1.454.light.4.raw

SEQ ID NO: 547113 - DNA, 493 bp, Homo sapiens
  misc_feature: HIJSMM301B6XUP.49.53.E09.1.454.light.4.raw
agtcgagagacacgaccggtgctcgatttagagagagtgtgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggacgaagctggaaagtacagacgaactgtggctgcaccat

SEQ ID NO: 547114 - DNA, 495 bp, Homo sapiens
  misc_feature: HIJSMM301CKHXH.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaacccactgtcactctgttcccacctcctcgagtagtaca

SEQ ID NO: 547115 - DNA, 490 bp, Homo sapiens; identical to SEQ ID NO: 538273
  misc_feature: HIJSMM301EKBOS.16.73.G07.1.454.light.4.raw

SEQ ID NO: 547116 - DNA, 489 bp, Homo sapiens
  misc_feature: HIJSMM301CLDRF.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggtcagtctccacacctcctgatttacgaagtttccaaccgcttcgctggactgccagataggttcagtggcagcgggtcagggacagattttacacttgaaaatcagccgggtggaggctgaggacgttggaattttattactgtatgcaaggtatagagcttcctccgacgttcggccaagggaccaaggtggaactcaaacgaa

SEQ ID NO: 547117 - DNA, 500 bp, Homo sapiens
  misc_feature: HIJSMM301BIMDY.40.42.D09.1.454.light.4.raw
  modified_base (235)..(235): a, c, t, g, unknown or other
tctagcgactcacgaccggtgctcgatttagacacatacgcagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaatntgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatgggtattcggcggagggaccaagctgaccgtcctaggtcagcccaaggctgccccctcggtcactctcg

SEQ ID NO: 547118 - DNA, 476 bp, Homo sapiens; identical to SEQ ID NO: 538026
  misc_feature: HIJSMM301CVZ35.13.76.G10.1.454.light.4.raw

SEQ ID NO: 547119 - DNA, 491 bp, Homo sapiens; identical to SEQ ID NO: 535294
  misc_feature: HIJSMM301AK1VB.16.68.G02.1.454.light.4.raw

SEQ ID NO: 547120 - DNA, 489 bp, Homo sapiens
  misc_feature: HIJSMM301BFKFA.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccaaggtggatctcaaagaactgtggctgcaccta

SEQ ID NO: 547121 - DNA, 488 bp, Homo sapiens; identical to SEQ ID NO: 543022
  misc_feature: HIJSMM301AFM8T.9.59.F04.1.454.light.4.raw

SEQ ID NO: 547122 - DNA, 444 bp, Homo sapiens; identical to SEQ ID NO: 535027
  misc_feature: HIJSMM301A9V7T.8.73.G07.1.454.light.4.raw

SEQ ID NO: 547123 - DNA, 523 bp, Homo sapiens
  misc_feature: HIJSMM301D0ETU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcattccagacaggttcagtggccgtgggtctgggacagagttcagtctcaccatcagcagactggagcctgaagattttgcagtatattactgtcagcaatatggtacttcaccccggacgttcggccaacgggaccgaacggtaggaaggtacaaacgaacctagtggcgtgcaccactctgtcttctactccttccgccactctgtat

SEQ ID NO: 547124 - DNA, 489 bp, Homo sapiens; identical to SEQ ID NO: 535139
  misc_feature: HIJSMM301DB9CP.14.55.E11.1.454.light.4.raw

SEQ ID NO: 547125 - DNA, 518 bp, Homo sapiens; identical to SEQ ID NO: 543797
  misc_feature: HIJSMM301C44FZ.19.80.H03.1.454.light.4.raw

SEQ ID NO: 547126 - DNA, 484 bp, Homo sapiens
  misc_feature: HIJSMM301AYAKF.49.34.D01.1.454.light.4.raw
agtcgagagacacgaccggtgctcgatttagatcgtctgtgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaaacagtatgataatctcccactcactttcggcggagggaccaaggtggagatcaaacgaactgtggctgcacca

SEQ ID NO: 547127 - DNA, 496 bp, Homo sapiens; identical to SEQ ID NO: 535660
  misc_feature: HIJSMM301D09DC.43.25.C03.1.454.light.4.raw

SEQ ID NO: 547128 - DNA, 466 bp, Homo sapiens; identical to SEQ ID NO: 546958
  misc_feature: HIJSMM301C5UE3.11.70.G04.1.454.light.4.raw

SEQ ID NO: 547129 - DNA, 496 bp, Homo sapiens; identical to SEQ ID NO: 535660
  misc_feature: HIJSMM301DNXB2.43.25.C03.1.454.light.4.raw

SEQ ID NO: 547130 - DNA, 497 bp, Homo sapiens
  misc_feature: HIJSMM301AFGGB.49.34.D01.1.454.light.4.raw
agtcgagagacacgaccggtgctcgatttagatcgtctgtgttgggtttggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggtccaggggaccgaagactggaaatacagacggaacctgtggctgcaccat

SEQ ID NO: 547131 - DNA, 501 bp, Homo sapiens
  misc_feature: HIJSMM301A3V0H.48.35.D02.1.454.light.4.raw
agtatacatacacgaccggtgctcgatttagcacacgatagttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgcccccg

SEQ ID NO: 547132 - DNA, 496 bp, Homo sapiens
  misc_feature: HIJSMM301DVECF.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatacaaacgaactgtggctgcac

SEQ ID NO: 547133 - DNA, 496 bp, Homo sapiens; identical to SEQ ID NO: 535423
  misc_feature: HIJSMM301DMG2L.3.33.C11.1.454.light.4.raw

SEQ ID NO: 547134 - DNA, 493 bp, Homo sapiens; identical to SEQ ID NO: 537239
  misc_feature: HIJSMM301AXVH3.49.66.F11.1.454.light.4.raw

SEQ ID NO: 547135 - DNA, 498 bp, Homo sapiens
  misc_feature: HIJSMM301ER65O.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtgagatcaaacgaactgtggctgcaccatctgtcttcatcttccccg

SEQ ID NO: 547136 - DNA, 454 bp, Homo sapiens; identical to SEQ ID NO: 536325
  misc_feature: HIJSMM301D9G53.19.86.H09.1.454.light.4.raw
  modified_base (436)..(436): a, c, t, g, unknown or other

SEQ ID NO: 547137 - DNA, 518 bp, Homo sapiens
  misc_feature: HIJSMM301C5P7J.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaacccactgtcactctgttcccaccctcctcgacaccg

SEQ ID NO: 547138 - DNA, 447 bp, Homo sapiens; identical to SEQ ID NO: 535201
  misc_feature: HIJSMM301AJCVT.18.9.A09.1.454.light.4.raw

SEQ ID NO: 547139 - DNA, 484 bp, Homo sapiens; identical to SEQ ID NO: 535441
  misc_feature: HIJSMM301AH1FS.26.60.F05.1.454.light.4.raw

SEQ ID NO: 547140 - DNA, 503 bp, Homo sapiens; identical to SEQ ID NO: 541454
  misc_feature: HIJSMM301DOVKM.9.12.B01.1.454.light.4.raw

SEQ ID NO: 547141 - DNA, 495 bp, Homo sapiens
  misc_feature: HIJSMM301BTEFK.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggaccaagggacacgactggagattaaaggaactgtggctgcaccatctgtcttcatcttccccg

SEQ ID NO: 547142 - DNA, 474 bp, Homo sapiens; identical to SEQ ID NO: 535264
  misc_feature: HIJSMM301EPC7A.13.76.G10.1.454.light.4.raw

SEQ ID NO: 547143 - DNA, 498 bp, Homo sapiens
  misc_feature: HIJSMM301AZ8Z4.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggttattactgcatgcaagctctacaacctctgcggacttttcggccctcgggaccaaagtaggaggatcaaacgaaactgtggctgcaccatctgtctt

SEQ ID NO: 547144 - DNA, 492 bp, Homo sapiens
  misc_feature: HIJSMM301B6NRT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatacaaacgaactgt

SEQ ID NO: 547145 - DNA, 496 bp, Homo sapiens; identical to SEQ ID NO: 537925
  misc_feature: HIJSMM301EDEE7.22.14.B03.1.454.light.4.raw

SEQ ID NO: 547146 - DNA, 496 bp, Homo sapiens
  misc_feature: HIJSMM301BZNO1.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctggctccagcctgaggatgaggctgattattactgcagctcatatgcaggcatcaacactgttttcggcggagggaccaagctgaccgtcctaggtcagcccaaggctgccccccg

SEQ ID NO: 547147 - DNA, 518 bp, Homo sapiens
  misc_feature: HIJSMM301AH381.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcgagggtcctgggcccaggtctgtagctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccaccctcctcg

SEQ ID NO: 547148 - DNA, 501 bp, Homo sapiens; identical to SEQ ID NO: 535746
  misc_feature: HIJSMM301BM5W3.18.11.A11.1.454.light.4.raw

SEQ ID NO: 547149 - DNA, 486 bp, Homo sapiens; identical to SEQ ID NO: 535385
  misc_feature: HIJSMM301AMSUS.19.71.G05.1.454.light.4.raw

SEQ ID NO: 547150 - DNA, 493 bp, Homo sapiens
  misc_feature: HIJSMM301A1O7V.48.3.A03.1.454.light.4.raw
agtatacatacacgaccggtgctcgatttagagagcgtcacagggggagtcagacccagtcaggacacagcatggacatgagggtccccgctcagctcctggggctcctgctgctctggctcccaggtgccaagtgtgccatccagatgacccagtctccttccaccctgtctgcatctgtgggagacagcgtcaccatcacttgccgggccagtcagaatattaatgactggttggcctggtatcaacagaaaccagggaaagcccctaaacttctgatctttcaggcatctaatttagaacatggggtcccatcaaggttcagcggcagtgggtttggcacagacttcactctcaccatcgccagcctgcagcccgatgattttgcaacttatttctgccaacaatacaccactttgtggacgttcggccgggggaccgaacggtggagatcaagcgaactgtggctgcaccatctgtcttcatcttcccg

SEQ ID NO: 547151 - DNA, 470 bp, Homo sapiens
  misc_feature: HIJSMM301C8V51.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgatgccacttttggcgggggaccaaggtggacatcaaacgaa

SEQ ID NO: 547152 - DNA, 481 bp, Homo sapiens; identical to SEQ ID NO: 537885
  misc_feature: HIJSMM301AL0D4.11.17.B06.1.454.light.4.raw

SEQ ID NO: 547153 - DNA, 504 bp, Homo sapiens; identical to SEQ ID NO: 543615
  misc_feature: HIJSMM301ED6LH.11.67.G01.1.454.light.4.raw

SEQ ID NO: 547154 - DNA, 493 bp, Homo sapiens
  misc_feature: HIJSMM301EIE7J.4.33.C11.1.454.light.4.raw
  modified_base (461)..(461): a, c, t, g, unknown or other
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcgtcggngggaccgaacggtagggagagtcaaacgaact

SEQ ID NO: 547155 - DNA, 505 bp, Homo sapiens
  misc_feature: HIJSMM301CZ0DX.12.53.E09.1.454.light.4.raw
atacgacgtacacgaccggtgctcgatttagagagagtgtgttgggtttggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgccctcctcctacgtcgtat

SEQ ID NO: 547156 - DNA, 502 bp, Homo sapiens
  misc_feature: HIJSMM301AIR0A.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttactcaagtgatcacctcgtccgaacggacgacgactggagattaaacg

SEQ ID NO: 547157 - DNA, 503 bp, Homo sapiens; identical to SEQ ID NO: 538884
  misc_feature: HIJSMM301DKEDV.27.78.H01.1.454.light.4.raw

SEQ ID NO: 547158 - DNA, 492 bp, Homo sapiens
  misc_feature: HIJSMM301CORIM.48.12.B01.1.454.light.4.raw
  modified_base (473)..(473): a, c, t, g, unknown or other
  modified_base (482)..(482): a, c, t, g, unknown or other
  modified_base (489)..(489): a, c, t, g, unknown or other
agtatacatacacgaccggtgctcgatttagtagtgtagattccgcgggggctgctcagttaggacccagagggaaccatggaaaccccagcgcagcttctcttcctcctgctactctggctcccagatactaccggagaagttctgttgacgcagtctccaggcaccctgtctttgtctccaggggaaagagccaccctctcctgcagggccagtcagactgttatcagcagctccttagcctggtaccagcagaaacctggccaggctcccaggctcctcatctatggtgcatccagcagggccgctggcatcccagacaggtttagtggcagtgggtctgggacagacttcactctcaccatcagcagactggagcctgaagattttgcagtgtatttctgtcagcagtatggtggctcacccgcgtacagtttgtcgacgggacgaacgacgtgaggatcaagagaacngtggcgtgnaccactnttc

SEQ ID NO: 547159 - DNA, 483 bp, Homo sapiens; identical to SEQ ID NO: 539663
  misc_feature: HIJSMM301EN382.17.34.D01.1.454.light.4.raw

SEQ ID NO: 547160 - DNA, 509 bp, Homo sapiens
  misc_feature: HIJSMM301APVMK.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaaacatggggatgacaatctgagcgggttgggtgttcggcggagggaccaaaactgaccgtcctaggtcagccccaa

SEQ ID NO: 547161 - DNA, 485 bp, Homo sapiens; identical to SEQ ID NO: 536075
  misc_feature: HIJSMM301DKSR9.17.21.B10.1.454.light.4.raw

SEQ ID NO: 547162 - DNA, 495 bp, Homo sapiens; identical to SEQ ID NO: 539061
  misc_feature: HIJSMM301DSIFJ.22.27.C05.1.454.light.4.raw

SEQ ID NO: 547163 - DNA, 487 bp, Homo sapiens; identical to SEQ ID NO: 535508
  misc_feature: HIJSMM301AX4MV.13.87.H10.1.454.light.4.raw

SEQ ID NO: 547164 - DNA, 477 bp, Homo sapiens
  misc_feature: HIJSMM301EOO5W.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagcccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctccctgtttttggtccaggggaccaaaggtggaggatcaaacgaactgtggctgcaccat

SEQ ID NO: 547165 - DNA, 496 bp, Homo sapiens; identical to SEQ ID NO: 538625
  misc_feature: HIJSMM301CAZBD.2.49.E05.1.454.light.4.raw

SEQ ID NO: 547166 - DNA, 490 bp, Homo sapiens
  misc_feature: HIJSMM301BMSA9.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatagaaaagaactgtggctgcaccat

SEQ ID NO: 547167 - DNA, 477 bp, Homo sapiens
  misc_feature: HIJSMM301C2B2J.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcggacccaggctatggatgaggctgactattactgtcaggcgtgggacatcagcagtgaggtggttttcggcggagggaccaagctgaccgtcctagtcagacccg

SEQ ID NO: 547168 - DNA, 496 bp, Homo sapiens
  misc_feature: HIJSMM301BAJLM.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaaagtggatatcaacgaactgtggctgcaccatctgtcttcatcttcccgccat

SEQ ID NO: 547169 - DNA, 503 bp, Homo sapiens; identical to SEQ ID NO: 536834
  misc_feature: HIJSMM301ANBIY.2.35.D02.1.454.light.4.raw

SEQ ID NO: 547170 - DNA, 502 bp, Homo sapiens; identical to SEQ ID NO: 537363
  misc_feature: HIJSMM301CELMP.18.23.C01.1.454.light.4.raw

SEQ ID NO: 547171 - DNA, 493 bp, Homo sapiens; identical to SEQ ID NO: 544335
  misc_feature: HIJSMM301DEGJT.5.57.F02.1.454.light.4.raw

SEQ ID NO: 547172 - DNA, 511 bp, Homo sapiens
  misc_feature: HIJSMM301DODOE.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgccact

SEQ ID NO: 547173 - DNA, 505 bp, Homo sapiens
  misc_feature: HIJSMM301CZ613.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcattttatttctgtcagcagtctgaagactggccgttcactttcggcggagggaccaaggtggacctcaaacgaactgtggctgcaccatctgtcttcatcttcccgcc

SEQ ID NO: 547174 - DNA, 492 bp, Homo sapiens; identical to SEQ ID NO: 535126
  misc_feature: HIJSMM301A5B8E.18.11.A11.1.454.light.4.raw

SEQ ID NO: 547175 - DNA, 490 bp, Homo sapiens; identical to SEQ ID NO: 537658
  misc_feature: HIJSMM301C6W5Z.14.55.E11.1.454.light.4.raw

SEQ ID NO: 547176 - DNA, 492 bp, Homo sapiens; identical to SEQ ID NO: 536175
  misc_feature: HIJSMM301CZ4P2.19.83.H06.1.454.light.4.raw

SEQ ID NO: 547177 - DNA, 486 bp, Homo sapiens; identical to SEQ ID NO: 535043
  misc_feature: HIJSMM301C0DJ4.46.35.D02.1.454.light.4.raw

SEQ ID NO: 547178 - DNA, 487 bp, Homo sapiens
  misc_feature: HIJSMM301DYQ5Z.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccgggggacacggctggaaactaaacgaactgtggctgcaccta

SEQ ID NO: 547179 - DNA, 483 bp, Homo sapiens; identical to SEQ ID NO: 535317
  misc_feature: HIJSMM301D7V0H.4.1.A01.1.454.light.4.raw

SEQ ID NO: 547180 - DNA, 443 bp, Homo sapiens
  misc_feature: HIJSMM301CMPMN.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccacctcctccgtgtctgat

SEQ ID NO: 547181 - DNA, 504 bp, Homo sapiens
  misc_feature: HIJSMM301D1V1X.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccgaaggtggagttcaaacgaactgtggctgcaccatctgtcttcatcttcccgccta

SEQ ID NO: 547182 - DNA, 447 bp, Homo sapiens
  misc_feature: HIJSMM301CWO7P.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtttctaatcgcttctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 547183 - DNA, 444 bp, Homo sapiens; identical to SEQ ID NO: 535192
  misc_feature: HIJSMM301EP686.5.9.A09.1.454.light.4.raw

SEQ ID NO: 547184 - DNA, 441 bp, Homo sapiens; identical to SEQ ID NO: 535074
  misc_feature: HIJSMM301AK0SW.11.3.A03.1.454.light.4.raw

SEQ ID NO: 547185 - DNA, 486 bp, Homo sapiens; identical to SEQ ID NO: 537310
  misc_feature: HIJSMM301AXSL7.15.28.C06.1.454.light.4.raw

SEQ ID NO: 547186 - DNA, 497 bp, Homo sapiens
  misc_feature: HIJSMM301BWCMB.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattatattgctgctcatatgcaggtagttacacttatgtcttcggaattgggacacggtcaccgtcctaggtcagcccaaggccaacccca

SEQ ID NO: 547187 - DNA, 487 bp, Homo sapiens
  misc_feature: HIJSMM301DSJ58.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagttttcggcggaggaccaaggtggagatcaaacgaactgtggctgcaccatctgt

SEQ ID NO: 547188 - DNA, 486 bp, Homo sapiens; identical to SEQ ID NO: 535043
  misc_feature: HIJSMM301ECN0O.46.35.D02.1.454.light.4.raw

SEQ ID NO: 547189 - DNA, 447 bp, Homo sapiens; identical to SEQ ID NO: 541817
  misc_feature: HIJSMM301BWT39.18.9.A09.1.454.light.4.raw

SEQ ID NO: 547190 - DNA, 477 bp, Homo sapiens; identical to SEQ ID NO: 543928
  misc_feature: HIJSMM301D10Q4.16.86.H09.1.454.light.4.raw

SEQ ID NO: 547191 - DNA, 498 bp, Homo sapiens; identical to SEQ ID NO: 535295
  misc_feature: HIJSMM301BECF3.15.25.C03.1.454.light.4.raw

SEQ ID NO: 547192 - DNA, 513 bp, Homo sapiens; identical to SEQ ID NO: 535719
  misc_feature: HIJSMM301AHELD.17.33.C11.1.454.light.4.raw

SEQ ID NO: 547193 - DNA, 504 bp, Homo sapiens; identical to SEQ ID NO: 535561
  misc_feature: HIJSMM301DP58U.4.57.F02.1.454.light.4.raw

SEQ ID NO: 547194 - DNA, 494 bp, Homo sapiens
  misc_feature: HIJSMM301D8DE8.48.63.F08.1.454.light.4.raw
agtatacatacacgaccggtgctcgatttagcgatcgtataagggggagtcagacccagtcaggacacagcatggacatgagggtccccgctcagctcctggggctcctgctgctctggctcccaggtgccgagtgtgacatccagatgacccagtttccttccgccctgtctgcatctgtgggagacagagtcaccatcacttgtcgggccagtcagagtgttaataagtggttggcctggtatcagcagaaacccgggaaagcccctaacctcctaatctatgaggcatctactctacaaagtggagtcccatccaggttcagcggcagtgcatctgggaccgacttcagtctcaccatcagcagcctgcaccctgatgattttgcaacttattactgtcaacaatattatacttacccgtacactttggccaggggactaagctggagatcaaacgaactgtggctgcaccatctgtcttcatcttccccg

SEQ ID NO: 547195 - DNA, 494 bp, Homo sapiens
  misc_feature: HIJSMM301D4J8L.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccggaagtggaggatcaaacgaaactgtggctgcaccactct

SEQ ID NO: 547196 - DNA, 485 bp, Homo sapiens
  misc_feature: HIJSMM301CB0QU.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttctcaccctcctcgctacgtaga

SEQ ID NO: 547197 - DNA, 496 bp, Homo sapiens; identical to SEQ ID NO: 542070
  misc_feature: HIJSMM301B5AOL.22.14.B03.1.454.light.4.raw

SEQ ID NO: 547198 - DNA, 361 bp, Homo sapiens; identical to SEQ ID NO: 544890
  misc_feature: HIJSMM301EGFW3.3.57.F02.1.454.light.4.raw

SEQ ID NO: 547199 - DNA, 484 bp, Homo sapiens; identical to SEQ ID NO: 535400
  misc_feature: HIJSMM301A88VU.46.26.C04.1.454.light.4.raw

SEQ ID NO: 547200 - DNA, 478 bp, Homo sapiens; identical to SEQ ID NO: 541575
  misc_feature: HIJSMM301COGL4.12.10.A10.1.454.light.4.raw

SEQ ID NO: 547201 - DNA, 486 bp, Homo sapiens; identical to SEQ ID NO: 535043
  misc_feature: HIJSMM301BKP02.46.35.D02.1.454.light.4.raw

SEQ ID NO: 547202 - DNA, 501 bp, Homo sapiens; identical to SEQ ID NO: 538431
  misc_feature: HIJSMM301C5AKQ.21.22.B11.1.454.light.4.raw

SEQ ID NO: 547203 - DNA, 485 bp, Homo sapiens
  misc_feature: HIJSMM301DN3Q6.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtacaaacagaaacctggccagtctcccaggctcctcatctatgatgcatccaacagggccactggcatcccagccaggttcagtggcagtgggtctgggacagacttcattctcaccatcagcagcctagagcctgaagattttgctctgtatcactgtcagcaatatggtggtacacccctcactttcggcggaggggccaaggtggagatcaagcgaactgtggctgcacc

SEQ ID NO: 547204 - DNA, 513 bp, Homo sapiens
  misc_feature: HIJSMM301ADJ3T.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtaccgagtggccgtccgggggccacgtttcggcccgtcgggaccgaagtggatatacaaacgaactagtggcgtgcaccactctgtt

SEQ ID NO: 547205 - DNA, 502 bp, Homo sapiens; identical to SEQ ID NO: 545020
  misc_feature: HIJSMM301AQFG4.18.11.A11.1.454.light.4.raw

SEQ ID NO: 547206 - DNA, 498 bp, Homo sapiens
  misc_feature: HIJSMM301AWSG4.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgactgtggctgcaccatctgtcttcatcttccccg

SEQ ID NO: 547207 - DNA, 491 bp, Homo sapiens; identical to SEQ ID NO: 538021
  misc_feature: HIJSMM301DCXHJ.3.72.G06.1.454.light.4.raw

SEQ ID NO: 547208 - DNA, 487 bp, Homo sapiens; identical to SEQ ID NO: 536206
  misc_feature: HIJSMM301AROA1.47.38.D05.1.454.light.4.raw

SEQ ID NO: 547209 - DNA, 510 bp, Homo sapiens; identical to SEQ ID NO: 535855
  misc_feature: HIJSMM301EU5ER.17.33.C11.1.454.light.4.raw

SEQ ID NO: 547210 - DNA, 481 bp, Homo sapiens
  misc_feature: HIJSMM301AT341.17.39.D06.1.454.light.4.raw
  modified_base (479)..(479): a, c, t, g, unknown or other
cgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatcaaacgaactgngg

SEQ ID NO: 547211 - DNA, 505 bp, Homo sapiens
  misc_feature: HIJSMM301E3OTY.8.28.C06.1.454.light.4.raw
ctcgcgtgtccacgaccggtgctcgatttagagctcacgtattgggtttggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccc

SEQ ID NO: 547212 - DNA, 484 bp, Homo sapiens; identical to SEQ ID NO: 544179
  misc_feature: HIJSMM301D0RIV.40.83.H06.1.454.light.4.raw

SEQ ID NO: 547213 - DNA, 447 bp, Homo sapiens; identical to SEQ ID NO: 535201
  misc_feature: HIJSMM301BELIE.18.9.A09.1.454.light.4.raw

SEQ ID NO: 547214 - DNA, 497 bp, Homo sapiens
  misc_feature: HIJSMM301CBODG.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaagtcagcccaagg

SEQ ID NO: 547215 - DNA, 512 bp, Homo sapiens
  misc_feature: HIJSMM301BF27O.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctct

SEQ ID NO: 547216 - DNA, 504 bp, Homo sapiens
  misc_feature: HIJSMM301CGF8I.48.55.E11.1.454.light.4.raw
agtatacatacacgaccggtgctcgatttagcactcgcacgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggtcaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 547217 - DNA, 507 bp, Homo sapiens
  misc_feature: HIJSMM301EE5RM.48.66.F11.1.454.light.4.raw
agtatacatacacgaccggtgctcgatttagtcacgcgagaagggcttgatgccttggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttggggcaacgccgccctcaccatcacgggggcccaggcagaggatgaggcgaattattattgtatgctccacaggggcaggggcacctgggagttcggcggcgggaccaagctgaccgtcctaggtcagcccaaggctgccccctc

SEQ ID NO: 547218 - DNA, 476 bp, Homo sapiens
  misc_feature: HIJSMM301BSVF0.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaaggaccgaagtaggaatacaacgaactgtggc

SEQ ID NO: 547219 - DNA, 497 bp, Homo sapiens
  misc_feature: HIJSMM301C3B33.11.12.B01.1.454.light.4.raw
  modified_base (439)..(439): a, c, t, g, unknown or other
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtggttcggcggnggggaccgagtctgaccgtccttaggttacgagcccgaacggcgtgccccctcccggt

SEQ ID NO: 547220 - DNA, 512 bp, Homo sapiens; identical to SEQ ID NO: 540108
  misc_feature: HIJSMM301AH1PK.40.12.B01.1.454.light.4.raw

SEQ ID NO: 547221 - DNA, 494 bp, Homo sapiens; identical to SEQ ID NO: 534992
  misc_feature: HIJSMM301EAS21.9.1.A01.1.454.light.4.raw

SEQ ID NO: 547222 - DNA, 446 bp, Homo sapiens
  misc_feature: HIJSMM301AD5YZ.10.76.G10.1.454.light.4.raw
catagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccgccctcctccactactatg

SEQ ID NO: 547223 - DNA, 504 bp, Homo sapiens
  misc_feature: HIJSMM301AEP8P.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactgtggctgcaccatct

SEQ ID NO: 547224 - DNA, 462 bp, Homo sapiens; identical to SEQ ID NO: 537922
  misc_feature: HIJSMM301DZQWP.10.9.A09.1.454.light.4.raw

SEQ ID NO: 547225 - DNA, 474 bp, Homo sapiens
  misc_feature: HIJSMM301B1B7N.5.28.C06.1.454.light.4.raw
atcagacacgcacgaccggtgctcgatttagagctcacgtattgggtttggggactttccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtcccaaactcctgatctacgatgcatctaatttggaaataggggtctcatcaaggttcagtgggagtggatctgggacagaattcactttcaccatcagcagcctgcaacctgaagatattgcaacatattactgtcaacagtatgatagtctggccgccttcggcggagggaccaaggtggagatcgaacgaactgtggctgcaccatctgtcttcatcttcccgccatctgacgt

SEQ ID NO: 547226 - DNA, 442 bp, Homo sapiens
  misc_feature: HIJSMM301CNC27.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctcgtacagacg

SEQ ID NO: 547227 - DNA, 479 bp, Homo sapiens; identical to SEQ ID NO: 537141
  misc_feature: HIJSMM301D9DG2.7.76.G10.1.454.light.4.raw

SEQ ID NO: 547228 - DNA, 476 bp, Homo sapiens; identical to SEQ ID NO: 541471
  misc_feature: HIJSMM301ARLPU.13.4.A04.1.454.light.4.raw

SEQ ID NO: 547229 - DNA, 480 bp, Homo sapiens
  misc_feature: HIJSMM301CQGSG.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggcccttgggaccacagtagatatcaaacgaactgtggctgcacc

SEQ ID NO: 547230 - DNA, 447 bp, Homo sapiens; identical to SEQ ID NO: 535201
  misc_feature: HIJSMM301CSET2.18.9.A09.1.454.light.4.raw

SEQ ID NO: 547231 - DNA, 502 bp, Homo sapiens
  misc_feature: HIJSMM301BJXC1.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgccccctcggtcactctgttccccaccctcctcgctacgtaga

SEQ ID NO: 547232 - DNA, 486 bp, Homo sapiens; identical to SEQ ID NO: 535043
  misc_feature: HIJSMM301AE08R.46.35.D02.1.454.light.4.raw

SEQ ID NO: 547233 - DNA, 489 bp, Homo sapiens; identical to SEQ ID NO: 544819
  misc_feature: HIJSMM301DTYBP.11.28.C06.1.454.light.4.raw

SEQ ID NO: 547234 - DNA, 496 bp, Homo sapiens
  misc_feature: HIJSMM301CEKUA.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtgggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactagtggctgcaccatctgtcttctatt

SEQ ID NO: 547235 - DNA, 494 bp, Homo sapiens; identical to SEQ ID NO: 536221
  misc_feature: HIJSMM301BS9PZ.15.59.F04.1.454.light.4.raw

SEQ ID NO: 547236 - DNA, 489 bp, Homo sapiens
  misc_feature: HIJSMM301E3EY0.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtctaacaggctaacactttcccctcactttcggcggagggaccaaggtggagatcaagcgaactgtggctgcaccat
